(12) United States Patent
Funck Jensen et al.

(10) Patent No.: US 12,185,725 B2
(45) Date of Patent: Jan. 7, 2025

(54) BCA CONTROL OF STB

(71) Applicant: DANSTAR FERMENT AG, Zug (CH)

(72) Inventors: Dan Funck Jensen, Uppsala (SE);
Birgit Mikkelsen, Hvidovre (DK);
Magnus Karlsson, Almunge (SE);
Margareta Hökeberg, Uppsala (SE)

(73) Assignee: DANSTAR FERMENT AG, Zug (CH)

( * ) Notice: Subject to any disclaimer, the term of this patent is extended or adjusted under 35 U.S.C. 154(b) by 823 days.

(21) Appl. No.: 16/956,237

(22) PCT Filed: Dec. 18, 2018

(86) PCT No.: PCT/SE2018/051331
§ 371 (c)(1),
(2) Date: Jun. 19, 2020

(87) PCT Pub. No.: WO2019/125294
PCT Pub. Date: Jun. 27, 2019

(65) Prior Publication Data
US 2021/0100251 A1    Apr. 8, 2021

(30) Foreign Application Priority Data
Dec. 19, 2017 (SE) .................... 1751575-0

(51) Int. Cl.
*A01N 63/30* (2020.01)
*A01N 25/30* (2006.01)
*A01N 43/12* (2006.01)

(52) U.S. Cl.
CPC ............. *A01N 63/30* (2020.01); *A01N 25/30* (2013.01); *A01N 43/12* (2013.01)

(58) Field of Classification Search
CPC ........ A01N 25/30; A01N 43/12; A01N 63/30; A01N 63/253
USPC ....................................................... 504/117
See application file for complete search history.

(56) References Cited

U.S. PATENT DOCUMENTS

2016/0007613 A1* 1/2016 Brown .................. A01N 63/30
504/117

FOREIGN PATENT DOCUMENTS

| CN | 102934632 A | * | 2/2013 | |
|---|---|---|---|---|
| EP | 2962568 A1 | | 1/2016 | |
| WO | 00/18241 A1 | | 4/2000 | |
| WO | WO-2013092224 A1 | * | 6/2013 | ............. A01N 37/50 |
| WO | 2015/011615 A1 | | 1/2015 | |
| WO | 2015/035504 A1 | | 3/2015 | |

OTHER PUBLICATIONS

Bolton, Melvin D. et al., Wheat leaf rust caused by Puccinia triticina, Molecular Plant Pathology, vol. 9, No. 5, pp. 563-575 (2008).
Perelló, Analia et al., Effect of *Trichoderma* spp. isolates for biological control of tan spot of wheat caused by Pyrenophora tritici-repentis under field conditions in Argentina, BioControl, DOI 10.1007/s10526-007-9110-4, pp. 1-10 (2006).
Liu, Na et al., Studies on the Control of Ascochyta Blight in Field Peas (*Pisum sativum* L.) Caused by Ascochyta pinodes in Zhejiang Province, China, Frontiers in Microbiology, vol. 7, No. 481, pp. 1-13 (Apr. 2016).
Jensen Birgit et al., Clonostachys rosea reduces spot blotch in barley by inhibiting prepenetration growth and sporulation of Bipolaris sorokiniana without inducing resistance, Pest Manag Sci, vol. 72, pp. 2231-2239 (2016).
Jensen, D. F. et al., Development of a biocontrol agent for plant disease control with special emphasis on the near commercial fungal antagonist Clonostachys rosea strain IK726', Australasian Plant Pathology, vol. 36, pp. 95-101 (2007).
Jensen, Birgit et al., Biological seed treatment of cereals with fresh and long-term stored formulations of Clonostachys rosea: Biocontrol efficacy against Fusarium culmorum, European Journal of Plant Pathology, vol. 106, pp. 233-242 (2000).
Comby, Morgane et al., Spatial and Temporal Variation of Cultivable Communities of Co-occurring Endophytes and Pathogens in Wheat, Frontiers in Microbiology, vol. 7, No. 403, pp. 1-16 (Mar. 2016).

* cited by examiner

*Primary Examiner* — Ali Soroush

(74) *Attorney, Agent, or Firm* — Porter Wright Morris & Arthur LLP

(57) ABSTRACT

The present invention generally relates to use of a biological control agent (BCA) in control of *Septoria tritici* blotch (STB) caused by *Mycosphaerella graminicola*. The BCA is, or comprises, *Clonostachys rosea*.

17 Claims, 3 Drawing Sheets

Specification includes a Sequence Listing.

BCA CONTROL OF STB

TECHNICAL FIELD

The present invention generally relates to use of a biological control agent (BCA) in control of *Septoria tritici* blotch (STB).

BACKGROUND

*Septoria tritici* blotch (STB), also referred to as *Septoria* leaf blotch, is caused by the filamentous fungus *Mycosphaerella graminicola* (older name *Septoria tritici*). *Mycosphaerella graminicola* is the name for the sexual stages of the fungus (teleomorph name). The corresponding name for the asexual stage of the fungus (anamorph name) is *Zymoseptoria tritici.*

STB caused by the ascomycete fungus *Mycosphaerella graminicola* is one of the most important foliar diseases of wheat. STB is characterized by necrotic lesions, see FIG. 1, on leaves and stems that develop after infected cells collapse, and is more prevalent during cool, wet weather. It is currently the most important disease of wheat in Europe and is among the top two or three most economically damaging diseases of this crop in the United States. Extensive applications of fungicides increase the worldwide economic costs attributed to STB.

A major problem with STB is that it is difficult to control due to resistance to multiple fungicides. The pathogen affects both bread wheat (*Triticum aestivum* L.), including winter wheat, and durum wheat (*T. turgidum* [L.] ssp. *durum*).

The initial symptoms of STB are small chlorotic spots on the leaves that appear soon after seedlings emerge in the fall or spring. As they enlarge, the lesions, see FIG. 2, become light tan and develop darker colored fruiting bodies, see FIG. 3. Lesions on mature leaves most often are long, narrow and delimited by leaf veins but can also be shaped irregularly or can be elliptical, particularly on seedlings or leaves that were young when infected. Mature lesions contain black or brown fruiting structures, the asexual pycnidia or sexual pseudothecia. The pycnidia or pseudothecia develop in the substomatal cavities of the host so are spaced regularly within the lesions, see FIG. 3.

STB is found commonly in the same fields and on the same plants as *Phaeosphaeria nodorum* (asexual stage: *Stagonospora nodorum*), the causal agent of *Stagonospora nodorum* blotch of wheat. When both pathogens occur together, they are referred to collectively as the *Septoria* blotch complex or *Septoria* complex.

The lifestyle of *M. graminicola* is hemibiotrophic. This means it is biotrophic early in the infection process, deriving its nutrition from the apoplast around living cells, then kills the surrounding host cells and becomes necrotrophic (utilizing dead tissue) during the later stages of infection, see FIG. 8. Infection of wheat by *M. graminicola* is thus characterized by two stages with at least five phases:

Stage 1—Biotrophic Growth:

i. Initial growth of the hyphae on the leaf surface; 0-24 hours after contact.

ii. Host penetration via natural openings, the stomata; 24-48 hours after contact, see FIG. 4.

iii. Intercellular biotrophic phase as hyphae extend within mesophyll tissue and obtain nutrients from the plant apoplast; 2-12 days after contact, see FIGS. 5-7.

Stage 2—Necrotrophic Growth:

iv. A rapid change to necrotrophic growth associated with the appearance of lesions on the leaf surface and collapse of the plant tissue; approximately 12-14 days after contact.

v. Further colonization of mesophyll tissue, see FIG. 8, and formation of pycnidia with conidia in substomatal cavities of senescent tissue; 14-28 days after contact.

During the necrotrophic stage, the hyphae macerate host cells causing collapse. Involvement of a toxin in the switch from biotrophic to necrotrophic growth is suspected.

Infection by *M. graminicola* is initiated by air-borne ascospores and splash-dispersed conidia produced on residues of the crop of the previous season, see FIG. 9. Primary infection occurs soon after seedlings emerge in fall (for winter wheat) or spring. Ascospore germ tubes are attracted to the stomata, through which they gain entry into the sub-stomatal cavity either directly or after production of an appressorium-like structure (infection cushion). For several days the hyphae grow intercellularly with little increase in biomass.

After the switch from biotrophic to necrotrophic growth, cells collapse, lesions form and are identified initially by small, yellow flecks or blotches. The lesions expand, primarily in the direction of the leaf veins to form long, narrow, necrotic blotches. Pycnidia develop around stomata within the necrotic areas of the lesions and exude conidia in gelatinous, hygroscopic cirrhi. These spores are disseminated by rain splash to leaves of the same or nearby plants. The pathogen survives crop-free periods primarily as pseudothecia but also in pycnidia on crop debris. Autumn-sown crops and volunteer plants can aid survival over winter.

*Journal of Plant Diseases and Protection* (1997), 104(6): 588-598 tested the suitability of *Trichoderma harzianum* and *Gliocladium roseum* as biocontrol agents for *Septoria tritici* and their efficiency in reducing disease severity on wheat plants under greenhouse conditions. There were no significant differences between wheat plants treated with the biocontrol agents and the control.

There is a need for an efficient treatment for STB, in particular in the light of the ever-increasing problem with fungicide-resistant *M. graminicola.*

SUMMARY

It is a general objective to provide an efficient treatment for STB.

This and other objectives are met by the embodiments as defined herein.

An aspect of the embodiments relates to use of *Clonostachys rosea* in inhibiting and/or controlling STB caused by *Mycosphaerella graminicola.*

Another aspect of the embodiments relates to a method of inhibiting and/or controlling STB caused by *M. graminicola*. The method comprises treating a wheat plant infected by *M. graminicola* with *C. rosea* or a biological control agent (BCA) composition comprising *C. rosea* and at least one auxiliary compound.

*C. rosea* strains can be used as efficient BCAs in inhibiting and/or controlling STB in wheat plants infected by *M. graminicola*. The *C. rosea* strains may also be combined with traditional chemical fungicide-based STB treatments.

BRIEF DESCRIPTION OF THE DRAWINGS

The embodiments, together with further objects and advantages thereof, may best be understood by making reference to the following description taken together with the accompanying drawings, in which.

DETAILED DESCRIPTION

Figure 2:
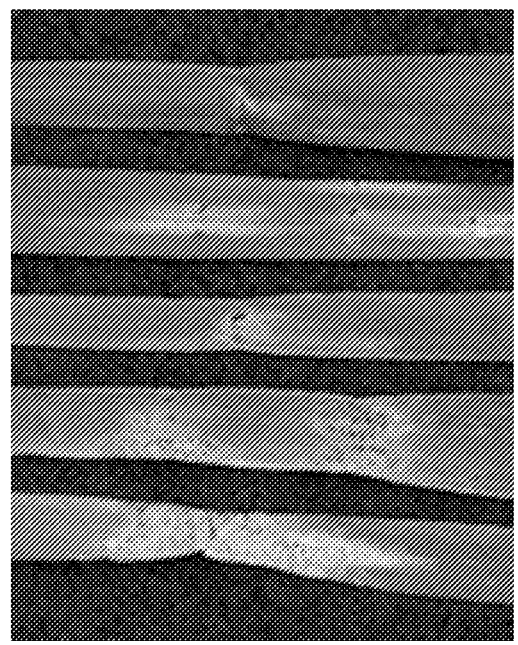
FIG. 2 illustrates lesions on wheat leaves caused by STB.
Figure 1:
FIG. 1 illustrates necrotic lesions on wheat leaves caused by STB.
Figure 3:
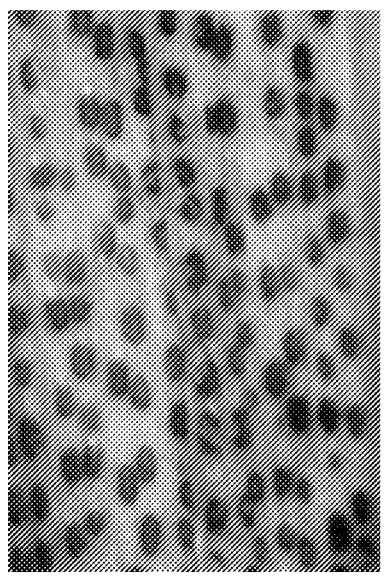
FIG. 3 illustrates fruiting bodies on wheat leaves caused by STB.
Figure 4:
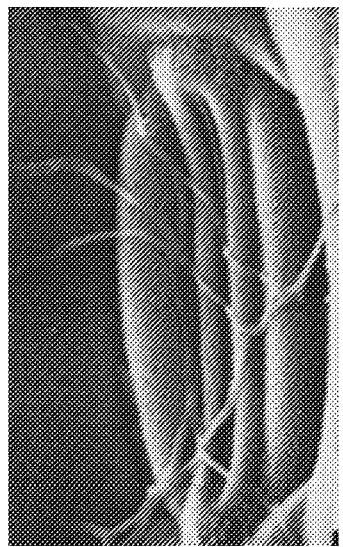
FIG. 4 illustrates penetration of *M. graminicola* via the stomata in wheat plants.
Figure 5:
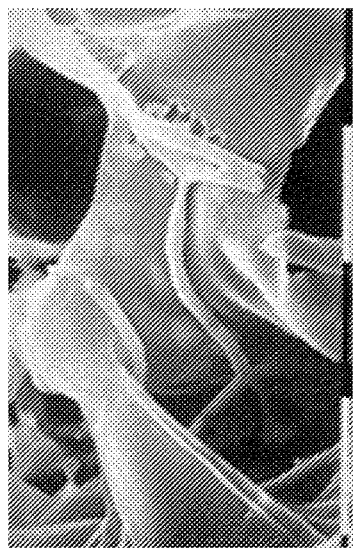
FIGS. 5-7 illustrate the extension of the *M. graminicola* hyphae within mesophyll tissue in wheat plants.
Figure 6:
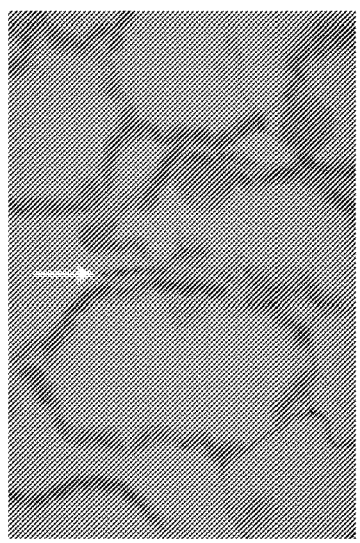
Figure 7:
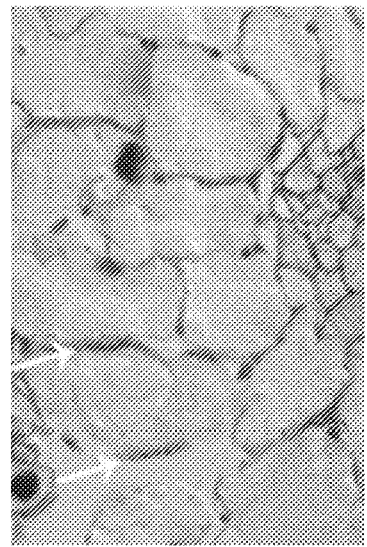
Figure 8:
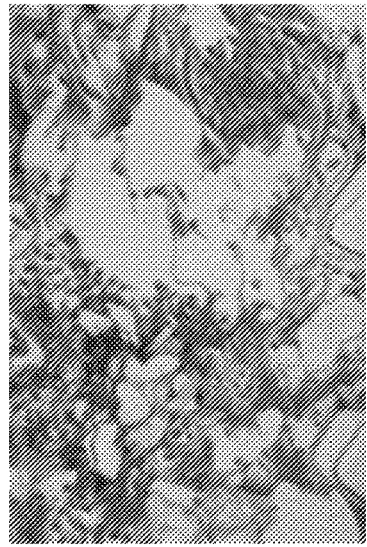
FIG. 8 illustrates formation of *M. graminicola* pycnidia with conidia in substomatal cavities of senescent tissue in wheat plants.
Figure 9:
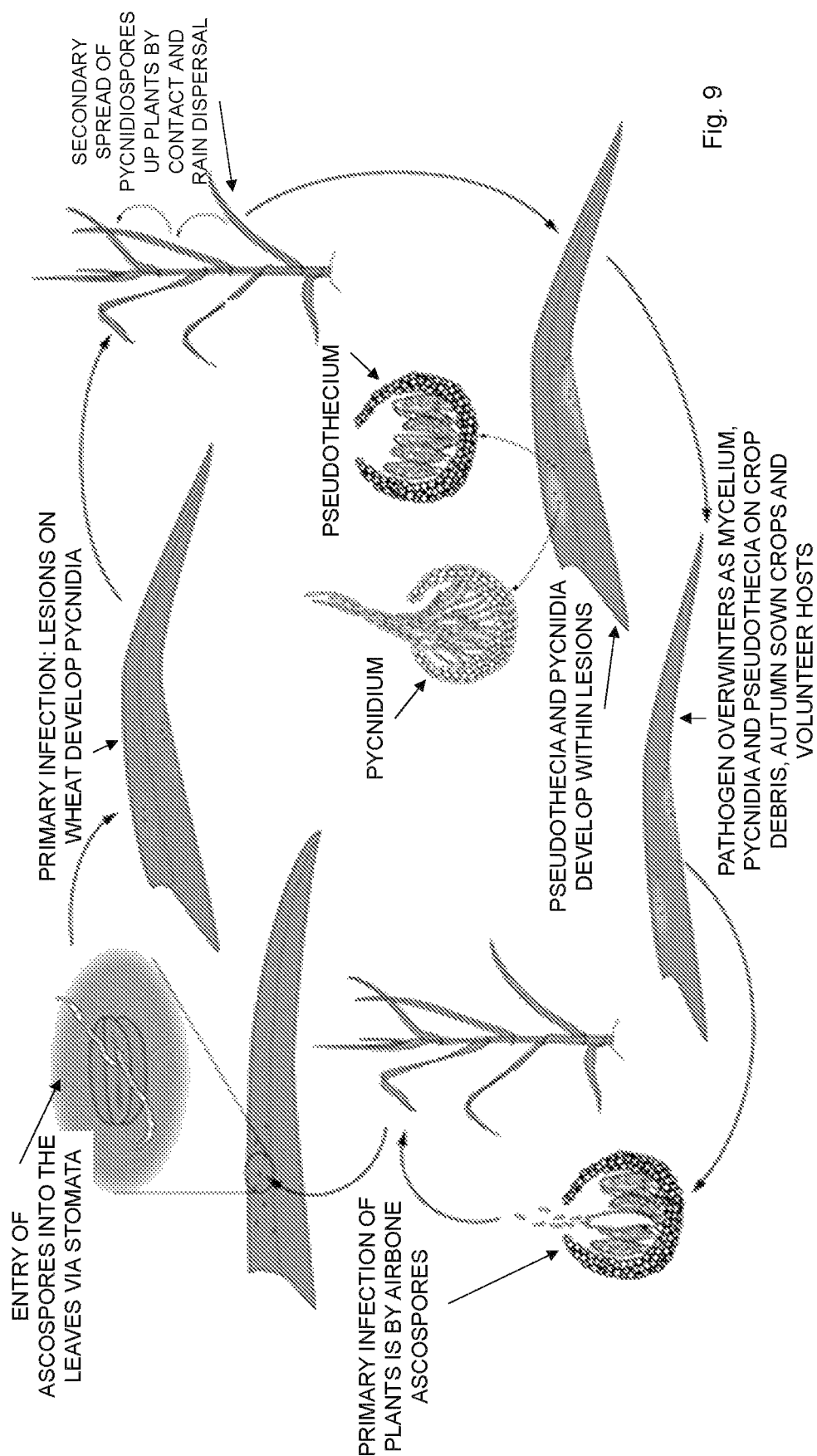
FIG. 9 illustrates infection of wheat plants by *M. graminicola* and development of STB.

The present invention generally relates to use of a biological control agent (BCA) in control of *Septoria tritici* blotch (STB).

STB caused by the ascomycete fungus *Mycosphaerella graminicola* is today one of the most important diseases of wheat. As a consequence, a vast amount of money is spent on combating STB, mainly by the usage of fungicides. However, fungicide resistance is becoming a major problem in STB with ever more *M. graminicola* strains becoming resistant to the fungicides traditionally used to treat or prevent STB.

Furthermore, *M. graminicola* is quite different from other leaf-disease-causing fungi in the way it causes disease first by its growth on the leaf surface and then entering through the natural openings (stomata) in the leaves. *M. graminicola* will have a long biotrophic stage, in which you generally do not see any symptoms (stage 1 mentioned in the background section). It is first when it goes into the necrotrophic stage (stage 2 mentioned in the background section) that any symptoms appear.

Most leaf pathogens have spores (conidia) landing on the leaves, where they germinate and penetrate directly into the leaf with no or very short time before the symptoms appear. For instance, leaf diseases caused by *Bipolaris sorokiniana* and *Drechslera teres* involve the production of toxins and killing of the plant cells at the time of infection. This is quite different from the disease progress in STB.

*Journal of Plant Diseases and Protection* (1997), 104(6): 588-598 tested the suitability of *Trichoderma harzianum* and *Gliocladium roseum* as biocontrol agents for *Septoria tritici* and their efficiency in reducing disease severity on wheat plants under greenhouse conditions. There were no significant differences between wheat plants treated with the biocontrol agents and the control. The authors concluded that there is often a low correlation between the effects achieved by biocontrol agents in vitro and the effectiveness to control disease in vivo.

In this article, a spore suspension of the *T. harzianum* isolate T15 or the *G. roseum* isolate G10 was sprayed on wheat seedlings prior to application of a suspension of *S. tritici* spores.

The inventors have used BCAs in terms of *Clonostachys rosea* strains (older name *Gliocladium roseum*) in field trials. These *C. rosea* strains achieved a significant control of STB as compared to control treatment. This significant control of STB was achieved by applying *C. rosea* strains on wheat plants already infected by *M. graminicola*. The significant effects achieved by the invention were highly surprising given that the article in *Journal of Plant Diseases and Protection* stated that the *G. roseum* isolate G10 had no effect in vivo on STB.

Thus, the present invention is directed towards use of *C. rosea* in inhibiting and/or controlling STB caused by *M. graminicola* (*Z. tritici*, *S. tritici*).

In an embodiment, *C. rosea* is selected from the group consisting of *C. rosea f. rosea*, *C. rosea f. catenulata*, and a mixture thereof.

*C. rosea f. rosea*, also known as *Gliocladium roseum*, and *C. rosea f. catenulata*, also known as *G. catenulatum*, are fungi in the family Bionectriacea. *C. rosea* colonized living plants as an endophyte, digests material in soil as a saprophyte and can also be used as a mycoparasite of other fungi and of nematodes.

In an embodiment, *C. rosea* is selected from the group consisting of *C. rosea* strain IK726, *C. rosea* strain 1829, *C. rosea* strain 1882, *C. rosea* strain 2177, *C. rosea* strain CBS 103.94, and a mixture thereof. Experimental data as presented herein shows that all of these *C. rosea* strains could be used as a BCA to inhibit and/or control STB.

Further *C. rosea* strains that can be used according to the invention are listed in Tables 5 to 7.

In an embodiment, *C. rosea* is used in inhibiting and/or controlling STB caused by *M. graminicola* on wheat plants infected by *M. graminicola*.

Thus, the invention preferably achieves a treatment, inhibition or control of STB in wheat plant already infected by *M. graminicola*.

Another aspect of the embodiments relates to a method of inhibiting and/or controlling STB caused by *M. graminicola*. The method comprises treating or contacting a wheat plant infected by *M. graminicola* with *C. rosea* or a BCA composition comprising *C. rosea* and at least one auxiliary compound.

In an embodiment, treating the wheat plant comprises spraying the *C. rosea* or the BCA composition onto at least a portion of the wheat plant.

For instance, *C. rosea* BCA or the BCA composition could be suspended in water to form a spray that can be applied to the wheat plant and/or seed in the form of a spray. *C. rosea* may advantageous be suspended in water in the form of a dry formulation according to Jensen et al. (2002). In brief, the dry formulation may be prepared by autoclaving a mixture of sphagnum, wheat bran and water (15:26:59 w/w/w) for 20 minutes on two successive days and then inoculated with two agar plugs of a strain of *C. rosea* and incubated in 250 ml Erlenmeyer flasks at room temperature for 14 days. The inoculum may be air-dried, milled in a coffee mill and then stored in sealed air-tight bags at 4° C. until use. Alternatively, or in addition, *C. rosea* may be suspended in water as spores.

In an embodiment, spraying *C. rosea* or the BCA composition comprises spraying the *C. rosea* or the BCA composition onto at least one of a pre-stem extension, a stem extension, and a leaf of the wheat plant.

When treating a wheat plant with *C. rosea* or the BCA composition the wheat plant can be treated with *C. rosea* or the BCA composition, such as by spraying, at various growth stages (referred to as GS in the following) of the wheat plant, including at early growth stages and/or at late growth stages.

For instance, the wheat plant can be treated with *C. rosea* or the BCA composition once at an early growth stage, multiple times at an early growth stage, once at a medium growth stage, multiple times at a medium growth stage, once at a late growth stage, multiple times at a late growth stage, once or multiple times at an early growth stage and once or multiple times at a medium growth stage, once or multiple times at an early growth stage and once or multiple times at a late growth stage, once or multiple times at a medium growth stage and once or multiple times at a late growth stage, or once or multiple times at an early growth stage, once or multiple times at a medium growth stage and once or multiple times at a late growth stage.

Early, medium and late growth stages are preferably as defined in the BBCH scale for wheat (cereals).

An early growth stage as used herein corresponds to growth stages within the range of GS 10-39, including leaf development, tillering and stem elongation stages. A late growth stage as used herein correspond to growth stages within the range of GS 61-89, including flowering, anthesis, development of fruit and ripening. A medium growth stage is a growth stage intermediate an early growth stage and a late growth stage and includes growth stages within the range of GS 41-59, including booting, inflorescence emergence and heading.

In addition to treating a wheat plant infected by *M. graminicola* also a plant substrate, in which the wheat plant is growing or to be grown, can be treated with *C. rosea* or the BCA composition, such as by adding *C. rosea* or the BCA composition comprising *C. rosea* and at least one auxiliary compound to the plant substrate.

The plant substrate can be any plant substrate commonly used to growth seeds or plants of wheat. Non-limiting but preferred examples of such plant substrates include soil, peat, compost, vermiculite, perlite, sand, rockwool or other types of inert material as well as substrates based on plant material, e.g., saw dust, waste of coco or stem and leaf material, or clay.

In the above described embodiments, *C. rosea* is preferably selected from the group consisting of *C. rosea f. rosea, C. rosea f. catenulata*, and a mixture thereof. For instance, *C. rosea* is selected from the group consisting of *C. rosea* strain IK726, *C. rosea* strain 1829, *C. rosea* strain 1882, *C. rosea* strain 2177, *C. rosea* strain CBS 103.94, and a mixture thereof, i.e., a mixture of two or more of the listed *C. rosea* strains.

In an embodiment, the at least one auxiliary compound in the BCA composition comprises a surfactant. Such a surfactant is a preferred auxiliary compound to keep *C. rosea*, such as spores of *C. rosea*, separated in a water suspension to prevent or at least reduce the risk of clump formation.

The surfactant is preferably a nonionic surfactant. Examples of such nonionic surfactants include polysorbate surfactants. Hence, in an embodiment the surfactant is selected from the group consisting of polysorbate 20 (polyoxyethylene (20) sorbitan monolaurate), polysorbate 40 (polyoxyethylene (20) sorbitan monopalmitate), polysorbate 60 (polyoxyethylene (20) sorbitan monostearate), polysorbate 80 (polyoxyethylene (20) sorbitan monooleate), and a mixture thereof. In a particular embodiment, the surfactant is polysorbate 20, also known as TWEEN® 20.

The surfactant could be included in the BCA composition in a concentration of from 0.001 up to 5%, (v/v) such as from 0.005 up to 1%, preferably from 0.01 up to 0.5%, such as about 0.1% of the BCA composition.

In an embodiment, the at least one auxiliary compound comprises at least one fungicide.

In these embodiments, the BCA composition comprises one fungicide or multiple, i.e., at least two, fungicides. The at least one fungicide is advantageously selected from fungicides traditionally used to treat or combat STB.

For instance, the at least one fungicide is selected from the group consisting of a demethylation inhibitor (DMI), an amine, a succinate-dehydrogenase inhibitor (SDHI), a quinone-outside inhibitor (QoI), a thiophene carboxamide, an anilino-pyrimidine (AP), an azanaphthalene, a phenylpyrrole (PP), a dicarboximide, a benzo-thiadiazole (BTH), a methyl benzimidazole carbamate (MBC), a phenyl-acetamide, an aryl-phenyl-ketone, a dithiocarbamate, a phtalimide, a chloronitrile, a bis-guanidine, and a mixture thereof.

In an embodiment, the DMI is selected from the group consisting of a piperazine, preferably triforine; a pyridine, preferably pyrifenox or pyrisoxazole; a pyrimidine, preferably fenarimol or nuarimol; an imidazole, preferably imazalil, oxpoconazole, pefurazoate, prochloraz or triflumizole; a triazole, preferably azaconazole, bitertanol, bromuconazole, cyproconazole, difenoconazole, diniconazole, epoxiconazole, etaconazole, fenbuconazole, fluquinoconazole, flusilazole, flutriafol, hexaconazole, imibenconazole, ipconazole, metconazole, myclobutanil, penconazole, propiconazole, prothioconazole, simeconazole, tebuconazole, tetraconazole, triadimefon, triadimenol, or triticonazole; and a mixture thereof.

In an embodiment, the amine is selected from the group consisting of a morpholine, preferably aldimorph, dodemorph, fenpropimorph or tridemorph; a piperidine, preferably fenpropidin or piperalin; a spiroketalamine, preferably spiroxamine; and a mixture thereof.

In an embodiment, the SDHI is selected from the group consisting of a phenyl-benzamide, preferably benodanil, flutolanil or mepronil; a phenyl-oxo-ethyl thiophene amid, preferably isofetamid; a pyridinyl-ethyl-benzamide, preferably fluopyramin; a pyridinyl-ethyl-benzamide, preferably fluopyram; a furan carboxamide, preferably fenfuram; an oxathiin carboxamide, preferably carboxin or oxycarboxin; a thiazole carboxamide, preferably thifluzamide; a pyrazole-4 carboxamide, preferably benzovindiflupyr, bixafen, fluxapyroxad, furametpyr, isopyrazam, penflufen, penthiopyrad or sedaxane; a N-methoxy-(phenyl-ethyl)-pyrazole carboxamide, preferably pydiflumetofen; a pyridine carboxamide, preferably boscalid; a pyrazine carboxamide, preferably pyraziflumid; and a mixture thereof.

In an embodiment, the QoI is selected from the group consisting of a methoxy acrylate, preferably azocystrobin, coumoxystrobin, enoxastrobin, flufenozystrobin, picozystrobin or pyraozystrobin; a methoxy acetamide, preferably mandestrobin; a methoxy carbamate, preferably pyraclostrobin, pyrametostrobin or triclopyricarb; an aximino acetate, preferably kresoxim-methyl or trifloxystrobin; an oximino acetamide, preferably dimoxystrobin, fenaminstrobin, metominostrobin or orysastrobin, an oxazolinde dione, preferably famoxadone, a dihydro dioxazine, preferably fluoxastrobin, an imidazolinone, preferably fenamidone; a benzyl carbamate, preferably pyribencarb; and a mixture thereof.

In an embodiment, the thiophene carboxamide is preferably silthiofam.

In an embodiment, the AP is selected from the group consisting of cyprodinil, mepanipyrim, pyrimethanil, and a mixture thereof.

In an embodiment, the azanaphthalene is selected from the group consisting of an aryloxyquinoline, preferably quinoxyfen; a quinazolinone, preferably proquinazid; and a mixture thereof.

In an embodiment, the PP is selected from the group consisting of fenpiclonil, fludioxonil, and a mixture thereof.

In an embodiment, the dicarboximide is selected from the group consisting of chlozolinate, dimethachlone, iprodione, procymdone, vinclozolin, and a mixture thereof.

In an embodiment, the BTH is acibenzolar-S-methyl.

In an embodiment, the MBC is selected from the group consisting of a benzimidazole, preferably benomyl, carbendazim, fuberidazole or thiabendazole; a thiophanate, preferably thiphanate or thiphanate-methyl; and a mixture thereof.

In an embodiment, the phenyl-acetamide is cyflufenamid.

In an embodiment, the aryl-phenyl-ketone is selected from the group consisting of a benzophenone, preferably metrafenone; a benzoylpyridine, preferably pyriofenone; and a mixture thereof.

In an embodiment, the dithiocarbamate is selected from the group consisting of ferbam, macozeb, maneb, metiram, propineb, thiram, zinc thiazole, zoneb, ziram, and a mixture thereof.

In an embodiment, the phtalimide is selected from the group consisting of captan, captafol, folpet and a mixture thereof.

In an embodiment, the chloronitrile is chlorothalonil.

In an embodiment, the bis-guanidine is selected from the group consisting of guazatine, iminoctadine, and a mixture thereof.

In a particular embodiment, the at least one fungicide is selected from the group consisting of boscalid, epoxiconazole, iprodione, metconazole, propiconazole, prothioconazole, pyraclostrobin, tebuconazole, and a mixture thereof.

The at least one fungicide may, for instance, be selected from commercially available fungicides including Bell (boscalid+epoxiconazole), Bumper 25 EC (propiconazole), Juventus 90 (metconazole), Osiris star (epoxiconazole+metconazole), Proline EC 250 (prothioconazole), Rubric (epoxiconazole), Prosaro 250 EC (tebuconazole+prothioconazole) and Viverda (epoxiconazole+boscalid+pyraclostrobin).

*C. rosea* strains can tolerate high dosages of active ingredients in commonly used chemical fungicides. For instance, experimental data as presented herein indicates that *C. rosea* strains can tolerate two commonly used active ingredients in fungicides; prothioconazole and iprodione.

In an embodiment, the at least one auxiliary compound comprises at least one insecticide.

The at least one insecticide can include a single insecticide or a mixture of multiple insecticides commonly used to protect wheat. A typical example of such an insecticide is furathiocarb.

In an embodiment, the at least one auxiliary compound comprises at least one herbicide.

In an embodiment, the at least one herbicide is selected from the group consisting of an acetyl coenzyme A carboxylase inhibitor, an acetolactate synthase inhibitor, an enolpyruvylshikimate 3-phosphate synthase inhibitor, a synthetic auxin herbicide, a photosystem II inhibitor, a photosystem I inhibitor, a 4-hydroxyphenylpyruvate dioxygenase inhibitor, and a mixture thereof.

In an embodiment, the at least one auxiliary comprises at least one BCA other than *C. rosea*.

For instance, the at least one BCA other than *C. rosea* may be selected from the group consisting of a *Bacillus* BCA, a *Serratia* BCA, a *Trichoderma* BCA, *Metarhizium brunneum, Glomus intraradices, Pseudomonas* BCA, and a mixture thereof. In a particular embodiment, the at least one BCA other than *C. rosea* is *Pseudomonas chlororaphis*.

The above described embodiments may be combined. Hence, the BCA composition may comprise, in addition to *C. rosea*, at least one surfactant and at least one fungicide; at least one surfactant and at least one insecticide; at least one surfactant and at least one herbicide; at least one surfactant and at least one BCA other than *C. rosea*; at least one fungicide and at least one insecticide; at least one fungicide and at least one herbicide; at least one fungicide and at least one BCA other than *C. rosea*; at least one insecticide and at least one herbicide; at least one insecticide and at least one BCA other than *C. rosea*; at least one herbicide and at least one BCA other than *C. rosea*; at least one surfactant, at least one fungicide and at least one insecticide; at least one surfactant, at least one fungicide and at least one herbicide; at least one surfactant, at least one fungicide and at least one BCA other than *C. rosea*; at least one surfactant, at least one insecticide and at least one herbicide; at least one surfactant, at least one insecticide and at least one BCA other than *C. rosea*; at least one surfactant, at least one herbicide and at least one BCA other than *C. rosea*; at least one fungicide, at least one insecticide and at least one herbicide; at least one fungicide, at least one insecticide and at least one BCA other than *C. rosea*; at least one fungicide, at least one herbicide and at least one BCA other than *C. rosea*; at least one insecticide, at least one herbicide and at least one BCA other than *C. rosea*; at least one surfactant, at least one fungicide, at least one insecticide and at least one herbicide; at least one surfactant, at least one fungicide, at least one insecticide and at least one BCA other than *C. rosea*; at least one surfactant, at least one insecticide, at least one herbicide and at least one BCA other than *C. rosea*; at least one fungicide, at least one insecticide, at least one herbicide and at least one BCA other than *C. rosea*; or at least one surfactant, at least one fungicide, at least one insecticide, at least one herbicide and at least one BCA other than *C. rosea*.

The application of *C. rosea* or the BCA composition of the invention onto plant of wheat, and optionally into the plant substrate, can be combined with chemical fungicide treatment. For instance, soil treatment could be performed at the time of sowing as both BCA treatment, i.e., with *C. rosea* or the BCA composition of the invention, and chemical fungicide treatment. Alternatively, or in addition, treatment could take place at the growing season of the wheat plant, such as a combined BCA and chemical fungicide treatment, or separate BCA and fungicide treatment, such as alternating BCA treatment and chemical fungicide treatment.

A further alternative, which can be used instead or as a complement to any of the other treatment options above or below, is to perform BCA treatment during the pre-harvest interval (PHI). It is also possible to perform post-harvest treatment using the BCA treatment or using BCA and fungicide treatments.

A further option, which can be used alone or combined with any of the alternatives above, is to perform BCA treatment of the soil and/or straw of wheat plants following harvest, i.e., in between crops.

Further aspects of the embodiments relates to usage of *C. rosea* strain 1829, *C. rosea* strain 1882, *C. rosea* strain 2177 as described herein. *C. rosea* strain 1829 was isolated from potato tuber (cultivar Eros) from a field near Vodice, Slovenia. *C. rosea* strain 1882 was isolated from eggs of *Diabrotica virgifera* incubated in soil from a field near Ljubljana, Slovenia. *C. rosea* strain 2177 was isolated from soil, 10 cm below the surface, from a field near Dolenji Novaki, Slovenia. The *C. rosea* strains are effective in combating STB as shown in the experimental section. These *C. rosea* strains are furthermore tolerant to the fungicides prothioconazole and iprodione, and also show growth under cold conditions. The genome of the three *C. rosea* strains has been sequenced and are presented in SEQ ID NO: 1 for *C. rosea* strain 1829, SEQ ID NO: 2 for *C. rosea* strain 1882 and SEQ ID NO: 3 for *C. rosea* strain 2177.

Further aspects relates to the use of *C. rosea* in preventing, inhibiting and/or controlling brown rust.

Hence, an embodiment relates to use of *Clonostachys rosea* in preventing, inhibiting and/or controlling brown rust caused by *Puccinia triticina*.

Another embodiment relates to a method of preventing, inhibiting and/or controlling brown rust caused by *Puccinia triticina*. The method comprises treating a plant or a seed of a plant with *Clonostachys rosea* or a biological control agent (BCA) composition comprising *C. rosea* and at least one auxiliary compound.

A further embodiment relates to a method of preventing, inhibiting and/or controlling brown rust caused by *Puccinia triticina*. The method comprises adding *Clonostachys rosea* or a biological control agent (BCA) composition comprising *C. rosea* and at least one auxiliary compound to a plant substrate. The method also comprises growing a seed of a plant or a plant in the plant substrate.

The previously described embodiments of suitable *C. rosea* strains, types of treatments and auxiliary compounds also apply to the above described uses of *C. rosea*.

EXAMPLES

Example 1—Field Experiments

Materials and Methods

The treatments compared in the field experiments 2013, 2015 and 2016 were either spraying the recommended dose of fungicide or application of the BCA *Clonostachys rosea* strain IK726 at growth stage 61 (GS 61) and determining the effect on *Fusarium* head blight (FHB), also referred to as *Fusarium* ear blight (FEB) or scab, and *Septoria tritici* blotch (STB). In 2015 and 2016, the effect of combining *C. rosea* with a BCA based on the bacterial strain *Pseudomonas chlororaphis* MA342 was also tested. In year 2015 the effects on STB of spraying different doses of *C. rosea* IK726 and the bacterial strain *P. chlororaphis* MA342 were tested. Specific treatments for each year are listed in Tables 1, 2 and 3.

The field experiment in 2017 differed from the other years by comparing five different *C. rosea* strains (*C. rosea f. rosea* and *C. rosea f. catenulata* isolated from different localities) against STB. 2017 also differed by introducing an early cover spray with the biocontrol agents at GS 37 substituting the early chemical fungicide cover spray in some of the treatments, see experimental procedure below. Table 4 gives an overview of each treatment.

Experimental Procedure

Experiments were carried out according to the Principles of Good Experimental Practice GEP under the direction of Dr. Lise Nistrup Jørgensen at the testing unit of Aarhus University, Department of Agroecology, Flakkebjerg, Forsøgsvej 1, DK-4200 Slagelse, Denmark.

The experimental design was a randomized complete block with four replicates and a plot size of 14.4-25.0 m$^2$.

The fungicides and the BCAs were applied with a self-propelled sprayer using low pressure (2.4 bar), Nardi flat fan nozzles, green ISO 015 and 150 l/ha.

Growth stages (Crop Maturity Stage) and Crop stage scale BBCH were defined according to Lancashire et al. (1991), which is modified from the scale of Zadoks: www.agric.wa.gov.au/grains/zadoks-growth-scale.

Two low dose cover sprays were applied at GS 31 and GS 37 to protect against main leaf diseases including STB. In field experiment 2017 this early fungicide sprays were substituted with biocontrol sprays in several treatments—see Table 4.

All plots in all years were artificially inoculated with a mixture of *Fusarium graminearum* and *Fusarium culmorum* at the beginning of GS 61 using 2×10.000 spores/ml in a water suspension complemented with 0.1% TWEEN® 20. There was no inoculation with *Septoria tritici* as the pathogen was present naturally in the field, causing disease in spite of the chemical fungicide cover sprays at the early stages GS 31 and GS 37.

BCAs

*C. rosea* strain IK726 (IK726) from Denmark.
*C. rosea* strain 1829 (CR1) from Slovenia.
*C. rosea* strain 1882 (CR2) from Slovenia.
*C. rosea* strain 2177 (CR3) from Slovenia.
*C. rosea* CBS 103.94 strain (CR4) from the CBS type collection in the Netherlands.
*Pseudomonas chlororaphis* (PC) strain MA342 from Sweden.

The *C. rosea* strain IK726 was used in 2013, 2015, and 2016. *C. rosea* strain IK726, *C. rosea* strain 1829, *C. rosea* strain 1882, *C. rosea* strain 2177 and *C. rosea* strain CBS 103.94 were used in 2017.

Production of Inoculum and Spray Formulations

*C. rosea* strains were in 2015, 2016 and 2017 propagated on wheat bran and formulated as a dry formulation according to Jensen et al. (2002). The dry formulated BCA was suspended in water complemented with 0.1% TWEEN® 20. In 2013 the inoculum of strain IK726 was made up of fresh spores harvested directly from cultures on potato dextrose agar (PDA) plates without prior drying before suspension in water and use for spray application.

The bacterial *P. chlororaphis* strain MA342 was propagated in liquid bacteriological media known in the art, e.g. a *Pseudomonas* liquid medium made up by mixing 30 g soy peptone, 5 g NaCl, 2.5 g K$_2$HPO$_4$ and 30 g glucose in 1000 ml H$_2$O, and suspended in water +0.1% TWEEN® 20 for spray applications.

Application Time for BCAs or Chemical Pesticides

Application time of biocontrol agents or pesticides is listed as application codes in the tables (Table 1, 2, 3 and 4). The application codes are as follows:

2013 (Table 1)

Code A=15.05.2013 (GS 32); Code B=04.06.2013 (GS 39-45); Code C=17.06.2013 (GS 61-69), Code D=18.06.2013 (GS 61-69), *Fusarium* inoculum was done at code C and the BCA treatment was either ½ day before *Fusarium* inoculum at code C or one day after *Fusarium* inoculation (code D).

2015 (Table 2)

Code A=27.04.2015 (GS 32); Code B=20.05.2015 (GS 39-45); Code C=22.06.2015 (GS 61-69).

2016 (Table 3)

Code A=10.05.2016 (GS 32); Code B=24.05.2016 (GS 39-45); Code C=04.06.2016 (GS 61-69).

2017 (Table 4)

Code A=26.05.2017 (GS 37-39); Code B=14.06.2017 (GS 61-65).

Application of BCAs

The spore concentrations were adjusted to give the following concentrations colony forming units (cfu) per $m^2$ with full dose applications:
- 2013: IK726: $1.35 \times 10^7$ cfu/$m^2$
- 2015: IK726: $7.0 \times 10^6$ cfu/$m^2$; MA342: $6.0 \times 10^8$ cfu/$m^2$
- 2016: IK726: $6.8 \times 10^6$ cfu/$m^2$; MA342: $4.5 \times 10^8$ cfu/$m^2$
- 2017: All five strains of *C. rosea* were spray inoculated in concentrations of $7.2 \times 10^6$ cfu/$m^2$ for each inoculation either at a late application (application code B) or both at an early and a late application (application code A+B) as shown in Table 4. A single early application of *C. rosea* strain IK726 (Code A) was also tested but not for the other 4 strains.

Mixed applications (2015 and 2016) were full dose: *C. rosea* IK726 full dose mixed with *P. chlororaphis* MA342 full dose. Reduced dosages used in year 2015 (shown in Table 2 as rate 100=100%, rate 50=50% and rate 10=10% of full dose) were calculated from full dosage of each organisms and then mixed before applications.

Disease assessments were carried out as percent coverage of all green leaves by the individual disease (Disease or pest severity=PESSEV). Registered diseases in the experiments were STB (*Septoria tritici* blotch, causal agent *Septoria tritici*), FHB (*Fusarium* head blight, causal agent(s) *Fusarium* spp) and brown rust (causal agent *Puccinia triticina*). Only results concerning STB are included in the Table 1-Table 3. In Table 4 (results from year 2017), results on biocontrol of brown rust caused by *Puccinia triticina* are also included.

EPPO Guidelines

The trials were carried out using the EPPO guidelines. In most cases, the assessment methods used are identical to EPPO (EPPO Guidelines PP 1/26(4), PP 1/135(4), PP 1/152 (4) and PP 1/181(4)). Leaf disease assessments were carried out on individual leaves.

Statistical Analysis

The datasets from the whole experiment from each year were subjected to analysis of variance and treatment means were separated at the 95% probability level using F-test. Treatments with the same letter are not significantly different when the method student-Newman-Keuls (P=0.05) is used.

Overview of application methods and equipment used with the field experiment from 2015 (Table 2) as an example.

Application Information

| | Application code | | |
|---|---|---|---|
| | A | B | C |
| Application Date: | Apr. 27, 2015 | May 20, 2015 | Jun. 22, 2015 |
| Application Method: | SPRAY | SPRAY | SPRAY |
| Application Placement: | FOLIAR | FOLIAR | FOLIAR |

Application Equipment

| | A | B | C |
|---|---|---|---|
| Appl. Equipment: | FL-Fung150 | FL-Fung150 | FL-Fung150 |
| Equipment Type: | SPRPNE | SPRPNE | SPRPNE |
| Operation Pressure | 2.4 BAR | 2.4 BAR | 2.4 BAR |
| Nozzle Type: | Minidrift | Minidrift | Minidrift |
| Nozzle Size: | 015 green | 015 green | 015 green |
| Nozzle Spacing: | 50 Cm | 50 Cm | 50 Cm |
| Nozzles/Row: | 5 | 5 | 5 |
| Band Width | 2.5 m | 2.5 m | 2.5 m |
| % Coverage: | 100 | 100 | 100 |
| Boom ID: | 1-6 | 1-6 | 1-6 |
| Boom Length | 250 cm | 250 cm | 250 cm |
| Boom Height | 50 cm | 50 cm | 50 cm |
| Ground Speed | 4.5 KPH | 4.5 KPH | 4.5 KPH |
| Carrier: | WATER | WATER | WATER |
| Spray Volume | 150 L/ha | 150 L/ha | 150 L/ha |
| Mix Size | 3 liters | 3 liters | 3 liters |
| Propellant: | COMAIR | COMAIR | COMAIR |
| Tank Mix (Y/N): | Y | Y | Y |

Test Products 2013

Chemical Fungicides:
  Bell (boscalid 233 g/l+epoxiconazole 67 g/l);
  Bumper 25 EC (propiconazole 250 g/l);
  Proline EC 250 (prothioconazole 250 g/l).
BCAs:
  *C. rosea* strain IK726.

Chemical fungicide (Bell and Bumper 25 EC) were applied as early cover spray applications code A and B. Chemical fungicide Proline EC 250 (application code C) was used as the fungicide reference to biocontrol treatments. *C. rosea* strain IK726 was applied at application code C (½ day before inoculation with *Fusarium*) or D (one day after inoculum with *Fusarium*).

Test Products 2015+2016

Chemical Fungicides:
  Proline EC 250 (prothioconazole 250 g/l);
  Rubric (epoxiconazole 125 g/l).
BCAs:
  *C. rosea* strain IK726;
  *P. chlororaphis* strain MA342;
  *C. rosea* strain IK726+*P. chlororaphis* strain MA342.

Chemical fungicide (Proline 0.3 l/ha and Rubric 0.5 l/ha) were applied in reduced dosages as early cover spray applications code A and B respectively. Chemical fungicide Proline EC 250 0.8 l/ha (application code C) was used as the fungicide reference to biocontrol treatments. *C. rosea* strain IK726 was applied at application code C either alone or combined with *P. chlororaphis* MA342. *P. chlororaphis* MA342 was also applied alone at application code C. Dosages used in combined BCA-mixes and reduced dosages of BCA is described above under application of BCAs and indicated in Table 2 and 3.

Test Products 2017

Chemical Fungicides:
  Viverda+Ultimate S (boscalid 140 g/l+epoxiconazool 50 g/l+pyraclostrobin 60 g/l);
  Prosaro 250 EC (tebuconazole 125 g/l+prothioconazole 125 g/l).

BCAs:
*C. rosea* strain IK726;
*C. rosea* strain 1829 (denoted CR1 in Table 4);
*C. rosea* strain 1882 (denoted CR2 in Table 4);
*C. rosea* strain 2177 (denoted CR3 in Table 4);
*C. rosea* strain CBS 103.94 (denoted CR4 in Table 4).

Chemical fungicide (Viverda+Ultimate S) was applied at early cover spray application code A. The *C. rosea* strains IK726, 1829, 1882, 2177 and CBS 103.94 were applied as an early application and a late application (application code A+B) or only at the late application as a single application (application code B). *C. rosea* strain IK726 was also tested as a single early application (application code A). Chemical fungicide Prosaro 250 EC (application code B) was used as the fungicide reference to biocontrol treatments.

Results

Results 2013

There was significant control of STB on leaf 2 by *C. rosea* IK726 in Treatment nos. 7, 8 and 9. These three treatments with biological control were not significant different from each other. The treatment with chemical fungicides (Treatment no. 6) also achieved a significant control of STB.

TABLE 1

Control of STB on wheat 2013

| | | | | | |
|---|---|---|---|---|---|
| Pest Type | | | D Disease | D Disease | |
| Pest Code | | | SEPTTR | SEPTTR | |
| Pest Scientific Name | | | Septoria triti | Septoria triti | |
| Crop Code | | | TRZAW | TRZAW | |
| Crop Name | | | Winter wheat | Winter wheat | |
| Part Rated | | | LEAF 2 C | LEAF 3 C | |
| Rating Date | | | Jun. 27, 2013 | Jun. 27, 2013 | |
| Rating Type | | | PESSEV | PESSEV | |
| Crop Stage | | | 69 | 69 | |
| Crop Stage Scale | | | BBCH | BBCH | |

| Trt no. | Treatment name | Rate (l/ha) | Appl Code | 1 | 2 |
|---|---|---|---|---|---|
| 1 | Bell | 0.5 | A | $3.3^a$ | $2.8^a$ |
| | Bumper 25 EC | 0.25 | A | | |
| | Bell | 0.5 | B | | |
| | Bumper 25 EC | 0.25 | B | | |
| | Untreated control | | D | | |
| 6 | Bell | 0.5 | A | $1.6^b$ | $1.4^a$ |
| | Bumper 25 EC | 0.25 | A | | |
| | Bell | 0.5 | B | | |
| | Bumper 25 EC | 0.25 | B | | |
| | Proline EC 250 | 0.8 | D | | |
| 7 | Bell | 0.5 | A | $0.6^b$ | $0.9^a$ |
| | Bumper 25 EC | 0.25 | A | | |
| | Bell | 0.5 | B | | |
| | Bumper 25 EC | 0.25 | B | | |
| | IK726 | 1 | C | | |
| 8 | Bell | 0.5 | A | $1.8^b$ | $2.8^a$ |
| | Bumper 25 EC | 0.25 | A | | |
| | Bell | 0.5 | B | | |
| | Bumper 25 EC | 0.25 | B | | |
| | IK726 | 1 | D | | |
| 9 | Bell | 0.5 | A | $1.4^b$ | $2.5^a$ |
| | Bumper 25 EC | 0.25 | A | | |
| | Bell | 0.5 | B | | |
| | Bumper 25 EC | 0.25 | B | | |
| | IK726 | 1 | CD | | |

| | | |
|---|---|---|
| LSD (P = 0.05) | 1.03 | 1.26 |
| Standard Deviation | 0.70 | 0.86 |
| CV | 50.65 | 47.16 |
| Bartlett's X2 | 19.056 | 8.376 |
| P(Bartlett's X2) | 0.015* | 0.398 |
| Replicate F | 1.011 | 0.916 |
| Replicate Prob(F) | 0.4053 | 0.4478 |

TABLE 1-continued

Control of STB on wheat 2013

| | | |
|---|---|---|
| Treatment F | 5.856 | 2.591 |
| Treatment Prob(F) | 0.0003 | 0.0339 |

All plots were inoculated with a mixture of *Fusarium graminearum*+*Fusarium culmorum* on Jun. 17, 2013 at GS 65. All biological control treatments with *C. rosea* were done either one day before (Treatment no. 7 Appl. Code C) or one day after (Treatment no. 8 Appl. Code D) or both one day before and one day after (Treatment no. 9 Appl. Code C+D) inoculation with *Fusarium* spp.

There were significant control of STB on leaf 2 by *C. rosea* IK726 in Treatment nos. 7, 8 and 9. These three treatments with biological control were not significant different from each other. The chemical fungicide treatment (Treatment no. 6) was showing a significant control of STB on leaf 2. No effects were registered on leaf 3.

Result 2015

Treatment nos. 3, 5, 8 and 9 showed significant disease control of STB. Of these Treatment nos. 5 and 8 showed significant effect with *C. rosea* in combination with the BCA *P. chlororaphis*. Treatment no. 7 also showed a biocontrol effect of the bacterial BCA on its own. Treatment nos. 10 and 11 were not significant probably due to the lower dose of *C. rosea* inoculum used in these treatments. The chemical treatment no. 2 was also significant.

TABLE 2

Control of STB on wheat 2015

| | |
|---|---|
| Pest Type | D Disease |
| Pest Code (SEPTTR = *Septoria tritici*) | SEPTTR |
| Crop Code | TRZAW |
| Crop Name | Winter wheat |
| Part Rated | LEAF 1 P |
| Rating Date | Jul. 15, 2015 |
| Rating Type (PESSEV = Pest-severity) | PESSEV |
| Rating Unit | % |
| Crop Stage Majority | 75 |
| Crop Stage Scale | BBCH |
| Assessed By | LNJ |
| Days After First/Last Application | 79    23 |
| Treatment-Evaluation Interval | −21 DA-A |

| Trt No. | Treatment Name | Rate | Appl Code | |
|---|---|---|---|---|
| 1 | Proline EC 250 | 0.3 | A | $15.5^a$ |
| | Rubric | 0.5 | B | |
| 2 | Proline EC 250 | 0.3 | A | $2.1^c$ |
| | Rubric | 0.5 | B | |
| | Proline EC 250 | 0.8 | C | |
| 3 | Proline EC 250 | 0.3 | A | $7.8^b$ |
| | Rubric | 0.5 | B | |
| | IK726 | 100 | C | |
| 4 | Proline EC 250 | 0.3 | A | $10.8^{ab}$ |
| | Rubric | 0.5 | B | |
| | MA342 | 100 | C | |
| 5 | Proline EC 250 | 0.3 | A | $7.5^b$ |
| | Rubric | 0.5 | B | |
| | IK726 + MA342 | 100 | CC | |
| 6 | Proline EC 250 | 0.3 | A | $12.5^{ab}$ |
| | Rubric | 0.5 | B | |
| | IK726 | 50 | C | |
| 7 | Proline EC 250 | 0.3 | A | $8.8^b$ |
| | Rubric | 0.5 | B | |
| | MA342 | 50 | C | |
| 8 | Proline EC 250 | 0.3 | A | $7.5^b$ |
| | Rubric | 0.5 | B | |
| | IK726 + MA342 | 50 | C | |

TABLE 2-continued

Control of STB on wheat 2015

| | | | | |
|---|---|---|---|---|
| 9 | Proline EC 250 | 0.3 | A | 9.3$^b$ |
| | Rubric | 0.5 | B | |
| | IK726 | 10 | CC | |
| 10 | Proline EC 250 | 0.3 | A | 11.5$^{ab}$ |
| | Rubric | 0.5 | B | |
| | MA342 | 10 | C | |
| 11 | Proline EC 250 | 0.3 | A | 123$^{ab}$ |
| | Rubric | 0.5 | B | |
| | IK726 + MA342 | 10 | C | |

| | |
|---|---|
| LSD P = .05 | 395 |
| Standard Deviation | 274 |
| CV | 2.856 |
| Bartlett's X2 | 5.151 |
| P(Bartlett's X2) | 0.881 |
| Replicate F | 0.643 |
| Replicate Prob(F) | 5.937 |
| Treatment F | 6.635 |
| Treatment Prob(F) | 0.001 |

Rate unit: l/ha for chemical treatments and BCAs is in % of full dose (see Material and Methods).

All biological control treatment either with *C. rosea* IK726 alone, *P. chlororaphis* strain MA342 alone or with combinations of these two BCAs were done at Jun. 22, 2015 (application code C). Therefore, the effects on STB of BCA treatments were only seen after that date. The determination on disease severity was done Jul. 15, 2015.

Treatment nos. 3, 5, 8 and 9 showed significant disease control of STB. Of these Treatment nos. 5 and 8 showed significant effect of *C. rosea* in combination with the biocontrol bacteria *P. chlororaphis*. Treatment no. 7 also showed a biocontrol effect of the bacterial BCA on its own. Treatment nos. 10 and 11 were not significant, probably due to the lower dose of *C. rosea* inoculum used in these treatments. The chemical treatment no. 2 was also significant.

Results 2016

Significant biocontrol of STB compared to the untreated control was found on leaf 1 on Jun. 29, 2016 in all treatments with *C. rosea* IK726 either as a single treatment (Treatment nos. 3, 6, 9+12) or in combination with *P. chlororaphis* MA342 (Treatment nos. 5, 8). *P. chlororaphis* MA342 also had significant effects as single applications (Treatment nos. 4, 7+10) on Jun. 29, 2016. Significant biocontrol effects were also seen on leaf 2 in almost all treatments already at Jun. 14, 2016 ten days after application of the biocontrol organisms (application code C).

TABLE 3

Control of STB on wheat 2016

| | 1 D Disease | 1 D Disease | 1 D Disease | 1 D Disease |
|---|---|---|---|---|
| Pest ID Code | | | | |
| Pest Code | SEPTTR | SEPTTR | SEPTTR | SEPTTR |
| Crop ID Code | 1 TRZAW | 1 TRZAW | 1 TRZAW | 1 TRZAW |
| Crop Name | Winter wheat | Winter wheat | Winter wheat | Winter wheat |
| Crop Variety | Nakskov | Nakskov | Nakskov | Nakskov |
| Part Rated | LEAF 2 P | LEAF 1 P | LEAF 2 P | LEAF 1 P |
| Rating Date | Jun. 14, 2016 | Jun. 29, 2016 | Jun. 29, 2016 | Jul. 5, 2016 |
| Rating Type | PESSEV | PESSEV | PESSEV | PESSEV |
| Rating Unit | % | % | % | % |
| Crop Stage Majority | 65 | 75 | 75 | 77 |
| Crop Stage Scale | BBCH | BBCH | BBCH | BBCH |
| Treatment-Evaluation Interval | 10 DA-C | 25 DA-C | 25 DA-C | 31 DAC- |
| Plant-Evaluation Interval | 274 DP-1 | 289 DP-1 | 289 DP-1 | 295 DP-1 |

| Trt No. and Name, Rate | Appl Code | 2 | 4 | 5 | 8 |
|---|---|---|---|---|---|
| 1 Proline EC250 0.3 l/ha | AB | 3.3$^{ab}$ | 26.3$^{ab}$ | 70.0$^a$ | 83.8$^a$ |
| 2 Proline EC250 0.3 l/ha | AB | 1.3$^c$ | 10.0$^e$ | 36.3$^b$ | 48.8$^b$ |
| 2 Proline EC250 0.8 l/ha | C | | | | |
| 3 Proline EC250 0.3 l/ha | AB | 2.3$^{abc}$ | 20.0$^{bcd}$ | 42.5$^{ab}$ | 80.0$^a$ |
| 3 IK726 | CC | | | | |
| 4 Proline EC250 0.3 l/ha | AB | 1.8$^{bc}$ | 15.0$^{de}$ | 37.5$^{ab}$ | 67.5$^{ab}$ |
| 4 MA342 | C | | | | |
| 5 Proline EC250 0.3 l/ha | AB | 1.8$^{bc}$ | 18.8$^{b-e}$ | 57.5$^{ab}$ | 78.8$^a$ |
| 5 IK726 | C | | | | |
| 5 MA342 | C | | | | |
| 6 Proline EC250 0.3 l/ha | AB | 2.3$^{abc}$ | 20.0$^{bcd}$ | 46.3$^{ab}$ | 67.5$^{ab}$ |
| 6 IK726 | C | | | | |
| 7 Proline EC250 0.3 l/ha | AB | 2.0$^{bc}$ | 18.8$^{b-e}$ | 46.3$^{ab}$ | 72.5$^{ab}$ |
| 7 MA342 | C | | | | |
| 8 Proline EC250 0.3 l/ha | AB | 1.8$^{bc}$ | 16.3$^{cde}$ | 46.3$^{ab}$ | 72.5$^{ab}$ |
| 8 IK726 | C | | | | |
| 8 MA342 | C | | | | |
| 9 Proline EC250 0.3 l/ha | AB | 2.5$^{abc}$ | 15.0$^{de}$ | 35.0$^b$ | 79.2$^a$ |
| 9 IK726 | C | | | | |
| 10 Proline EC250 0.3 l/ha | AB | 2.0$^{bc}$ | 18.8$^{b-e}$ | 47.5$^{ab}$ | 72.5$^{ab}$ |
| 10 MA342 | C | | | | |
| 11 Proline EC250 0.3 l/ha | AB | 1.8$^{bc}$ | 25.0$^{abe}$ | 55.0$^{ab}$ | 81.3$^a$ |
| 11 IK726 | C | | | | |
| 11 MA342 | C | | | | |
| 12 Proline EC250 0.3 l/ha | AB | 2.5$^{abc}$ | 18.8$^{b-e}$ | 56.3$^{ab}$ | 77.5$^a$ |
| 12 IK726 | C | | | | |
| 13 Proline EC250 0.3 l/ha | AB | 2.3$^{abc}$ | 20.5$^{bcd}$ | 58.8$^{ab}$ | 71.3$^{ab}$ |
| 13 MA342 | C | | | | |

TABLE 3-continued

Control of STB on wheat 2016

| Pest ID Code | 1 D Disease | 1 D Disease | 1 D Disease | 1 D Disease |
|---|---|---|---|---|
| Pest Code | SEPTTR | SEPTTR | SEPTTR | SEPTTR |
| Crop ID Code | 1 TRZAW | 1 TRZAW | 1 TRZAW | 1 TRZAW |
| Crop Name | Winter wheat | Winter wheat | Winter wheat | Winter wheat |
| Crop Variety | Nakskov | Nakskov | Nakskov | Nakskov |
| Part Rated | LEAF 2 P | LEAF 1 P | LEAF 2 P | LEAF 1 P |
| Rating Date | Jun. 14, 2016 | Jun. 29, 2016 | Jun. 29, 2016 | Jul. 5, 2016 |
| Rating Type | PESSEV | PESSEV | PESSEV | PESSEV |
| Rating Unit | % | % | % | % |
| Crop Stage Majority | 65 | 75 | 75 | 77 |
| Crop Stage Scale | BBCH | BBCH | BBCH | BBCH |
| Treatment-Evaluation Interval | 10 DA-C | 25 DA-C | 25 DA-C | 31 DAC- |
| Plant-Evaluation Interval | 274 DP-1 | 289 DP-1 | 289 DP-1 | 295 DP-1 |

| Trt No. and Name, Rate | Appl Code | 2 | 4 | 5 | 8 |
|---|---|---|---|---|---|
| 14 Untreated control | | $3.8^a$ | $30.0^a$ | $70.0^a$ | $90.0^a$ |
| LSD P = 0.05 | | 0.93 | 5.66 | 18.49 | 15.67 |
| Standard Deviation | | 0.66 | 3.98 | 12.98 | 11.00 |
| CV | | 29.53 | 20.41 | 25.73 | 14.61 |
| Bartlett's X" | | 13.48 | 14.649 | 28.825 | 15.938 |
| P(Bartlett's X") | | 0.411 | 0.33 | 0.04* | 0.317 |
| Replicate F | | 4.417 | 3.119 | 1.486 | 9.918 |
| Replicate Prob(F) | | 0.0083 | 0.0352 | 0.2311 | 0.0001 |
| Treatment F | | 3.408 | 5.705 | 2.886 | 2.869 |
| Treatment Prob(F) | | 0.0007 | 0.0001 | 0.0030 | 0.0033 |

All plots were inoculated with *Fusarium* spp. in the same way as in 2013 and 2015. There was no inoculation with *Septoria tritici*. Dose IK726: $6.8 \times 10^6$ cfu/m$^2$; MA342: $4.5 \times 10^8$ cfu/m$^2$.

Significant biocontrol of STB compared to the untreated control was found on Jun. 29, 2016 in all treatments with *C. rosea* IK726 either as a single treatment (Treatment nos. 3, 6, 9+12) or in combination with *P. chlororaphis* MA342 (Treatment nos. 5 and 8). An exception was treatment no. 11. *P. chlororaphis* MA342 also had significant effects as single applications (Treatment nos. 4, 7+10) on Jun. 29, 2016.

Significant biocontrol effects were also seen on leaf 2 in several BCA-treatments already at Jun. 14, 2016 ten days after application of the biocontrol organisms (application code C).

Results 2017

All five isolates of *C. rosea* showed significant effect on STB on leaf L2 on Jun. 26, 2017 and in all treatments on leaf L1, Jul. 6, 2017 except on Treatment no. 4 (application code B of *C. rosea* IK726 leaf L1). There were significant effects of all biocontrol treatments with the late treatments (application code B treatments except Leaf L1 Treatment no. 4), and in all treatments with both an early and a late application of *Clonostachys* spp. (Application code A+B for both leaf L1 assessed on Jul. 6, 2017 and L2 assessed on Jun. 26, 2017 (Treatment nos. 5, 7, 11, 13)). Disease assessment on leaf L1 at Jun. 26, 2017 showed no significant biological disease control and the late disease assessment Jul. 17, 2017 did not show significant biological disease control effects. The early treatment with *C. rosea* IK726 (application code A Treatment no. 3) showed a significant biological disease control on leaf L1 on Jul. 6, 2017 and on leaf L2 on Jun. 26, 2017. The other four isolates were not tested for an early single application (application code A).

All five tested *C. rosea* isolates gave significant biological disease control effects against STB.

TABLE 4

Control of STB on wheat 2017

| | | | | D Disease | D Disease | D Disease | D Disease | D Disease |
|---|---|---|---|---|---|---|---|---|
| | Pest Type | | | SEPTTR | SEPTTR | SEPTTR | SEPTTR | PUCCRT |
| | Pest Code | | | Speckled leaf | Speckled leaf | Speckled leaf | Speckled leaf | Brown rust |
| | Pest Name | | | TRZAW | TRZAW | TRZAW | TRZAW | TRZAW |
| | Crop Code | | | Winter wheat | Winter wheat | Winter wheat | Winter wheat | Winter wheat |
| | Crop Name | | | L1 | L2 | L1 | L1 C | L1 P |
| | Part Rated | | | 26 Jun. 2017 | 26 Jun. 2017 | 6 Jul. 2017 | 17 Jul. 2017 | 26 Jun. 2017 |
| | Rating Date | | | PESSEV | PESSEV | PESSEV | PESSEV | PESSEV |
| | Rating Type | | | % | % | % | % | % |
| | Rating Unit | | | 73 | 73 | 77 | 83 | 77 |
| | Crop Stage Majority | | | | | | | |
| Trt no. | Trt name | Rate (l/ha) | Appl Code | | | | | |
| 1 | Untreated control | | | 6.0a | $22.5^a$ | $31.3^a$ | $100.0^a$ | $5.00^a$ |
| 2 | Viverda | 0.75 | A | $1.3^b$ | $7.8^c$ | $2.0^d$ | $20.0^c$ | $0.03^c$ |
| | Ultima S | 0.75 | A | | | | | |
| | Prosaro 250 EC | 0.75 | B | | | | | |
| 3 | IK726 | | A | $3.0^{ab}$ | $15.0^b$ | $18.8^{bc}$ | $100.0^a$ | $3.25^{ab}$ |
| 4 | IK726 | | B | $3.5^{ab}$ | $14.3^b$ | $25.0^{ab}$ | 100.0a | $2.50^b$ |

TABLE 4-continued

Control of STB on wheat 2017

| | | | | | | | |
|---|---|---|---|---|---|---|---|
| 5 | IK726 | A B | $4.0^{ab}$ | $15.0^{b}$ | $20.3^{bc}$ | 100.0a | $3.75^{ab}$ |
| 6 | CR1 | B | $4.3^{ab}$ | $14.5^{b}$ | $19.3^{bc}$ | $100.0^{a}$ | $4.00^{ab}$ |
| 7 | CR1 | A B | $4.3^{ab}$ | $16.5^{b}$ | $20.0^{bc}$ | $100.0^{a}$ | $2.75^{ab}$ |
| 8 | CR2 | B | $4.5^{ab}$ | $14.3^{b}$ | $21.3^{bc}$ | $100.0^{a}$ | $3.25^{ab}$ |
| 9 | CR2 | A B | $6.0^{a}$ | $17.3^{b}$ | $20.8^{bc}$ | $100.0^{a}$ | $3.50^{ab}$ |
| 10 | CR3 | B | $4.0^{ab}$ | $15.0^{b}$ | $17.3^{bc}$ | $100.0^{a}$ | $4.50^{ab}$ |
| 11 | CR3 | A B | $3.3^{ab}$ | $12.3^{b}$ | $13.8^{c}$ | $100.0^{a}$ | $3.00^{ab}$ |
| 12 | CR4 | B | $3.5^{ab}$ | $15.0^{b}$ | $22.0^{bc}$ | $100.0^{a}$ | $2.25^{b}$ |
| 13 | CR4 | A B | $3.5^{ab}$ | $15.0^{b}$ | $22.5^{bc}$ | $100.0^{a}$ | $2.75^{ab}$ |
| 14 | Viverda Ultimate S 075 0.75 | A A | $1.5^{b}$ | $6.5^{c}$ | $3.3^{d}$ | $38.8^{b}$ | $0.00^{c}$ |
| LSD P = 0.05 | | | 1.92 | 3.38 | 6.27 | 1.88 | |
| Standard Deviation | | | 1.34 | 2.36 | 4.39 | 1.31 | |
| CV | | | 35.74 | 16.47 | 23.87 | 1.46 | |
| Bartlett's X2 | | | 13.381 | 10.257 | 18.877 | 0.686 | |
| P(Bartlett's X2) | | | 0.342 | 0.507 | 0.127 | 0.407 | |
| Skewness | | | 0.6866* | 0.2575 | -0.4743 | -2.1947* | |
| Kurtosis | | | 0.4176 | 2.5955* | -0.1992 | 3.1088* | |
| Replicate F | | | 1.100 | 1.575 | 0.583 | 0.258 | |
| Replicate Prob(F) | | | 0.3607 | 0.2109 | 0.6299 | 0.8550 | |
| Treatment F | | | 4.046 | 10.553 | 12.483 | 1553.424 | |

Five different *Clonostachys rosea* isolates were tested in 2017 for their effects against STB. All 14 treatments were artificially inoculated with a mixture of *Fusarium graminearum*+*Fusarium culmorum* on Jun. 17, 2017 at GS 65.

Conclusions

*C. rosea* gave significant biocontrol of *Septoria tritici* in the field experiments 2013, 2015, 2016 and 2017 and the effects were also seen when combined with the bacterial strain *P. chlororaphis* MA342. Significant biocontrol effect on STB were seen with all five different *C. rosea* strains tested in 2017. In 2017 a significant control of brown rust was also registered in treatment 4 and 12, i.e., significant biocontrol effect of strains IK726 and CBS 103.94.

Example 2—Growth Rate Measurements on Agar Media

Agar plugs with actively growing mycelium of *Clonostachys rosea* strains were inoculated to ½ strength potato dextrose agar (PDA) medium (Oxoid, Cambridge, UK) plates supplemented with 0.005 μg/mL (final concentration) prothioconazole (proline), ½ strength PDA plates supplemented with 0.25 mg/mL (final concentration) iprodione, and incubated at 25° C. in darkness. Half strength PDA plates inoculated with *C. rosea* strains were also incubated at 10° C. in darkness. Growth rates were measured continuously up to 24 days after inoculation. All strains grew on prothioconazole (Table 5), iprodione (Table 6) and at 10° C. (Table 7).

TABLE 5

Growth rates of *Clonostachys rosea* strains on ½ strength potato dextrose agar plates supplemented with 0.005 μg/mL (final concentration) prothioconazole incubated at 25° C.

| Isolate | Growth rate (mm/day) | Geographic origin |
|---|---|---|
| CBS 125111 | 0.50828 | Costa Rica |
| CBS 118757 | 0.546527 | Taiwan |
| GR4 | 0.627859 | Denmark |
| 1832 | 0.644491 | Slovenia |
| CBS 907.72D | 0.6469 | Armenia |
| CBS 916.97 | 0.652807 | Mexico |
| CBS 649.80 | 0.668938 | Tunisia |
| 2176 | 0.67493 | Slovenia |
| CBS 154.27 | 0.677755 | USA |
| CBS 376.55 | 0.683262 | USA |
| 2177 | 0.684474 | Slovenia |
| 1830 | 0.68476 | Slovenia |
| CBS 221.72A | 0.689512 | Germany |
| GR3 | 0.692515 | France |
| 1829 | 0.694287 | Slovenia |
| CBS 569.69 | 0.71023 | Switzerland |
| GR33 | 0.710817 | New Zealand |
| CBS 124004 | 0.712142 | USA |
| 1827 | 0.713249 | Slovenia |
| CBS 361.77 | 0.721543 | Switzerland |
| 2175 | 0.734558 | Slovenia |
| 1316 | 0.739356 | Slovenia |
| 1883 | 0.742277 | Slovenia |
| 1833 | 0.74739 | Slovenia |
| 1421 | 0.747664 | Slovenia |
| CBS 704.97 | 0.765966 | USA |
| CBS 100502 | 0.766587 | France |
| 2169 | 0.776618 | Slovenia |
| 2178 | 0.777547 | Slovenia |
| 2173 | 0.780467 | Slovenia |
| 1881 | 0.792988 | Slovenia |
| GR5 | 0.797603 | Denmark |
| CBS 148.72 | 0.798337 | Ukraine |
| CBS 123305 | 0.80167 | USA |
| CBS 222.93 | 0.813856 | Chile |
| CBS 289.78 | 0.817591 | Jamaica |
| CBS 706.97 | 0.826584 | USA |
| GR31 | 0.832212 | Guyana |
| CBS 708.97 | 0.833506 | USA |
| 1701 | 0.852914 | Slovenia |
| CBS 907.72E | 0.85595 | Armenia |
| CBS 287.78 | 0.858387 | USA |

TABLE 5-continued

Growth rates of *Clonostachys rosea* strains on ½ strength potato dextrose agar plates supplemented with 0.005 µg/mL (final concentration) prothioconazole incubated at 25° C.

| Isolate | Growth rate (mm/day) | Geographic origin |
|---|---|---|
| CBS 178.28 | 0.863012 | UK |
| CBS 277.50 | 0.872287 | USA |
| CBS 224.72A | 0.890177 | Germany |
| CBS 443.65 | 0.908239 | USA |
| GR34 | 0.90985 | New Zealand |
| CBS 907.72G | 0.912405 | Azerbaijan |
| 1885 | 0.924951 | Slovenia |
| CBS 421.87 | 0.933981 | Spain |
| CBS 193.94 | 0.957985 | Venezuela |
| CBS 115883 | 1.000103 | Argentina |
| 1884 | 1.001669 | Slovenia |
| CBS 548.79 | 1.014388 | Venezuela |
| CBS 438.70 | 1.016561 | Japan |
| CBS 705.97 | 1.021988 | USA |
| CBS 188.33 | 1.033165 | Netherlands |
| CBS 100000 | 1.063344 | Australia |
| CBS 216.74 | 1.070359 | Brazil |
| CBS 103.94 | 1.125649 | Netherlands |
| IK726 | 1.125649 | Denmark |
| GR35 | 1.13811 | New Zealand |
| 1882 | 1.142264 | Slovenia |

TABLE 6

Growth rates of *Clonostachys rosea* strains on ½ strength potato dextrose agar plates supplemented with 0.25 mg/mL (final concentration) iprodione incubated at 25° C.

| Isolate | Growth rate (mm/day) | Geographic origin |
|---|---|---|
| CBS 118757 | 0.22908 | Taiwan |
| CBS 224.72A | 0.234299 | Germany |
| CBS 569.69 | 0.2873 | Switzerland |
| CBS 124004 | 0.29383 | USA |
| 1833 | 0.302251 | Slovenia |
| CBS 704.97 | 0.312949 | USA |
| GR34 | 0.3275 | New Zealand |
| 1421 | 0.329032 | Slovenia |
| 2169 | 0.340836 | Slovenia |
| 2177 | 0.353698 | Slovenia |
| 2176 | 0.367742 | Slovenia |
| CBS 708.97 | 0.402363 | USA |
| CBS 115883 | 0.412506 | Argentina |
| CBS 287.78 | 0.418006 | USA |
| 2175 | 0.424437 | Slovenia |
| CBS 100000 | 0.454324 | Australia |
| 1701 | 0.457068 | Slovenia |
| GR4 | 0.464888 | Denmark |
| 2173 | 0.469453 | Slovenia |
| GR5 | 0.496246 | Denmark |
| CBS 125111 | 0.527172 | Costa Rica |
| CBS 289.78 | 0.540885 | Jamaica |
| 1832 | 0.551679 | Slovenia |
| CBS 548.79 | 0.57273 | Venezuela |
| CBS 222.93 | 0.6 | Chile |
| CBS 154.27 | 0.603602 | USA |
| CBS 376.55 | 0.623608 | USA |
| CBS 907.72G | 0.643087 | Azerbaijan |
| CBS 443.65 | 0.65083 | USA |
| 2178 | 0.692132 | Slovenia |
| CBS 193.94 | 0.715312 | Venezuela |
| GR33 | 0.74639 | New Zealand |
| CBS 907.72E | 0.763602 | Armenia |
| CBS 123305 | 0.765273 | USA |
| CBS 907.72D | 0.787504 | Armenia |
| GR31 | 0.85582 | Guyana |
| 1829 | 0.879756 | Slovenia |
| CBS 216.74 | 0.892599 | Brazil |
| CBS 421.87 | 0.904653 | Spain |
| 1827 | 0.910107 | Slovenia |

TABLE 6-continued

Growth rates of *Clonostachys rosea* strains on ½ strength potato dextrose agar plates supplemented with 0.25 mg/mL (final concentration) iprodione incubated at 25° C.

| Isolate | Growth rate (mm/day) | Geographic origin |
|---|---|---|
| CBS 100502 | 0.930687 | France |
| CBS 221.72A | 0.943972 | Germany |
| CBS 706.97 | 0.982157 | USA |
| 1881 | 0.993548 | Slovenia |
| 1884 | 1 | Slovenia |
| CBS 916.97 | 1.00555 | Mexico |
| 1885 | 1.014609 | Slovenia |
| CBS 148.72 | 1.067278 | Ukraine |
| CBS 103.94 | 1.070907 | Netherlands |
| CBS 649.80 | 1.111289 | Tunisia |
| CBS 361.77 | 1.130197 | Switzerland |
| IK726 | 1.178589 | Denmark |
| CBS 178.28 | 1.194224 | UK |
| 1883 | 1.207089 | Slovenia |
| 1830 | 1.209003 | Slovenia |
| CBS 277.50 | 1.232943 | USA |
| 1316 | 1.272108 | Slovenia |
| GR3 | 1.351616 | France |
| CBS 705.97 | 1.445161 | USA |
| GR35 | 1.451613 | New Zealand |
| CBS 188.33 | 1.528335 | Netherlands |
| CBS 438.70 | 1.604191 | Japan |
| 1882 | 1.664516 | Slovenia |

TABLE 7

Growth rates of *Clonostachys rosea* strains on ½ strength potato dextrose agar plates incubated at 10° C.

| Isolate | Radius (mm after 24 days at 10° C.) | Geographic origin |
|---|---|---|
| CBS 708.97 | 1.583 | USA |
| 1881 | 3.083 | Slovenia |
| IK726 | 3.167 | Denmark |
| GR34 | 3.667 | New Zealand |
| CBS 704.97 | 3.833 | USA |
| 1827 | 4.167 | Slovenia |
| 1885 | 4.167 | Slovenia |
| CBS 706.97 | 4.417 | USA |
| CBS 277.50 | 4.500 | USA |
| CBS 569.69 | 4.583 | Switzerland |
| CBS 649.80 | 4.667 | Tunisia |
| 1829 | 4.667 | Slovenia |
| GR3 | 4.667 | France |
| CBS 100000 | 4.833 | Australia |
| 1884 | 5.000 | Slovenia |
| 1830 | 5.167 | Slovenia |
| CBS 222.93 | 5.250 | Chile |
| CBS 115883 | 5.250 | Argentina |
| CBS 907.72G | 5.333 | Azerbaijan |
| CBS 287.78 | 5.417 | USA |
| CBS 916.97 | 5.417 | Mexico |
| 1833 | 5.583 | Slovenia |
| CBS 100502 | 5.583 | France |
| CBS 548.79 | 5.750 | Venezuela |
| 1701 | 6.250 | Slovenia |
| CBS 148.72 | 6.667 | Ukraine |
| 1883 | 6.667 | Slovenia |
| CBS 907.72D | 6.750 | Armenia |
| CBS 421.87 | 6.833 | Spain |
| 2176 | 7.083 | Slovenia |
| GR31 | 7.083 | Guyana |
| GR5 | 7.417 | Denmark |
| CBS 289.78 | 7.667 | Jamaica |
| CBS 154.27 | 7.833 | USA |
| 1316 | 7.833 | Slovenia |
| 2177 | 7.833 | Slovenia |

TABLE 7-continued

Growth rates of Clonostachys rosea strains on ½ strength potato dextrose agar plates incubated at 10° C.

| Isolate | Radius (mm after 24 days at 10° C.) | Geographic origin |
|---|---|---|
| CBS 178.28 | 8.000 | UK |
| CBS 216.74 | 8.000 | Brazil |
| GR35 | 8.250 | New Zealand |
| CBS 125111 | 8.333 | Costa Rica |
| CBS 907.72E | 8.417 | Armenia |
| 2178 | 8.583 | Slovenia |
| CBS 193.94 | 8.917 | Venezuela |
| GR33 | 9.500 | New Zealand |
| CBS 376.55 | 9.583 | USA |
| CBS 438.70 | 9.583 | Japan |
| CBS 705.97 | 9.583 | USA |
| CBS 188.33 | 9.833 | Netherlands |
| 1832 | 9.833 | Slovenia |
| 1882 | 9.917 | Slovenia |
| CBS 103.94 | 11.250 | Netherlands |

The results indicate that *C. rosea* strains are tolerant towards commonly used fungicides and can thereby be combined with chemical treatment of STB.

The embodiments described above are to be understood as a few illustrative examples of the present invention. It will be understood by those skilled in the art that various modifications, combinations and changes may be made to the embodiments without departing from the scope of the present invention. In particular, different part solutions in the different embodiments can be combined in other configurations, where technically possible. The scope of the present invention is, however, defined by the appended claims.

REFERENCES

Jensen, B., Knudsen, I. M. B., and Jensen, D. F. 2002. Survival of conidia of *Clonostachys rosea* coated on barley seeds and their biocontrol efficacy against seed-borne *Bipolaris sorokiniana*. Biocontrol Sci. Technol. 12:427-441.

Lancashire, P. D., Bleiholder, H., van den Boom, T., Langelüddeke, P., Stauss, R., Weber, E. and Witzenberger, A. (1991). A uniform decimal code for growth stages of crops and weeds. Ann. Appl. Biol. 119: 561-601.

SEQUENCE LISTING (3 sequences)

SEQ ID NO: 1 - DNA, 63241173 bp, Clonostachys rosea (residues 1-2,040,038 of 63,241,173)
  misc_feature (1004022)..(1004022): n is a, c, g, or t
  misc_feature (1004884)..(1004886): n is a, c, g, or t
  misc_feature (1007091)..(1007093): n is a, c, g, or t
  misc_feature (1273510)..(1273515): n is a, c, g, or t
  misc_feature (1491479)..(1491516): n is a, c, g, or t
  misc_feature (1622006)..(1622008): n is a, c, g, or t
  misc_feature (1622486)..(1622526): n is a, c, g, or t
  misc_feature (1945921)..(1945923): n is a, c, g, or t
  misc_feature (2186631)..(2186631): n is a, c, g, or t
  misc_feature (2363519)..(2363519): n is a, c, g, or t
  misc_feature (3003988)..(3004034): n is a, c, g, or t
  misc_feature (3006951)..(3006951): n is a, c, g, or t
  misc_feature (3039734)..(3039736): n is a, c, g, or t
  misc_feature (3046114)..(3046168): n is a, c, g, or t
  misc_feature (3047352)..(3047352): n is a, c, g, or t
  misc_feature (3460813)..(3460816): n is a, c, g, or t
  misc_feature (3639064)..(3639064): n is a, c, g, or t
  misc_feature (3746222)..(3746222): n is a, c, g, or t
  misc_feature (4241995)..(4242004): n is a, c, g, or t
  misc_feature (4475448)..(4475448): n is a, c, g, or t
  misc_feature (4510206)..(4510206): n is a, c, g, or t
  misc_feature (4560264)..(4560274): n is a, c, g, or t
  misc_feature (4664816)..(4664831): n is a, c, g, or t
  misc_feature (4665147)..(4665225): n is a, c, g, or t
  misc_feature (4689063)..(4689097): n is a, c, g, or t
  misc_feature (4799467)..(4799467): n is a, c, g, or t
  misc_feature (5267192)..(5267251): n is a, c, g, or t
  misc_feature (5268549)..(5268551): n is a, c, g, or t
  misc_feature (5633359)..(5633359): n is a, c, g, or t
  misc_feature (5655891)..(5655906): n is a, c, g, or t
  misc_feature (5766024)..(5766046): n is a, c, g, or t
  misc_feature (5929755)..(5929755): n is a, c, g, or t
  misc_feature (6255892)..(6255898): n is a, c, g, or t
  misc_feature (6511898)..(6511903): n is a, c, g, or t
  misc_feature (6716454)..(6716471): n is a, c, g, or t
  misc_feature (7713256)..(7713332): n is a, c, g, or t
  misc_feature (7813886)..(7813898): n is a, c, g, or t
  misc_feature (8154636)..(8154652): n is a, c, g, or t
  misc_feature (8385915)..(8385915): n is a, c, g, or t
  misc_feature (8643645)..(8643659): n is a, c, g, or t
  misc_feature (8818690)..(8818690): n is a, c, g, or t
  misc_feature (8823963)..(8823969): n is a, c, g, or t
  misc_feature (8871470)..(8871513): n is a, c, g, or t
  misc_feature (8931084)..(8931169): n is a, c, g, or t
  misc_feature (9235562)..(9235572): n is a, c, g, or t
  misc_feature (9481541)..(9481541): n is a, c, g, or t
  misc_feature (9963013)..(9963026): n is a, c, g, or t
  misc_feature (10103656)..(10103667): n is a, c, g, or t
  misc_feature (10255692)..(10255692): n is a, c, g, or t
  misc_feature (10262298)..(10262305): n is a, c, g, or t
  misc_feature (10301030)..(10301032): n is a, c, g, or t
  misc_feature (10451609)..(10451614): n is a, c, g, or t
  misc_feature (10731373)..(10731373): n is a, c, g, or t
  misc_feature (11696241)..(11696273): n is a, c, g, or t
  misc_feature (11739018)..(11739018): n is a, c, g, or t
  misc_feature (11965869)..(11966018): n is a, c, g, or t
  misc_feature (11976640)..(11976679): n is a, c, g, or t
  misc_feature (12069619)..(12069643): n is a, c, g, or t
  misc_feature (12107239)..(12107253): n is a, c, g, or t
  misc_feature (12161236)..(12161255): n is a, c, g, or t
  misc_feature (12179157)..(12179160): n is a, c, g, or t
  misc_feature (12556274)..(12556274): n is a, c, g, or t
  misc_feature (12770113)..(12770124): n is a, c, g, or t
  misc_feature (12998503)..(12998542): n is a, c, g, or t
  misc_feature (13065570)..(13065570): n is a, c, g, or t
  misc_feature (13066700)..(13066724): n is a, c, g, or t
  misc_feature (13093959)..(13093979): n is a, c, g, or t
  misc_feature (13125970)..(13125983): n is a, c, g, or t
  misc_feature (13148715)..(13148723): n is a, c, g, or t
  misc_feature (13293327)..(13293329): n is a, c, g, or t
  misc_feature (14016619)..(14016619): n is a, c, g, or t
  misc_feature (14407542)..(14407544): n is a, c, g, or t
  misc_feature (14411025)..(14411025): n is a, c, g, or t
  misc_feature (14704475)..(14704482): n is a, c, g, or t
  misc_feature (15155196)..(15155196): n is a, c, g, or t
  misc_feature (15190628)..(15190628): n is a, c, g, or t
  misc_feature (15287798)..(15287841): n is a, c, g, or t
  misc_feature (15650558)..(15650558): n is a, c, g, or t
  misc_feature (15662298)..(15662309): n is a, c, g, or t
  misc_feature (16619049)..(16619049): n is a, c, g, or t
  misc_feature (16631697)..(16631734): n is a, c, g, or t
  misc_feature (16945683)..(16945683): n is a, c, g, or t
  misc_feature (17533823)..(17533829): n is a, c, g, or t
  misc_feature (17703140)..(17703140): n is a, c, g, or t
  misc_feature (17882033)..(17882033): n is a, c, g, or t
  misc_feature (18448568)..(18448625): n is a, c, g, or t
  misc_feature (18847351)..(18847351): n is a, c, g, or t
  misc_feature (18866422)..(18866422): n is a, c, g, or t
  misc_feature (19275043)..(19275067): n is a, c, g, or t
  misc_feature (19692510)..(19692520): n is a, c, g, or t
  misc_feature (19781619)..(19781678): n is a, c, g, or t
  misc_feature (20675280)..(20675280): n is a, c, g, or t
  misc_feature (20695841)..(20695843): n is a, c, g, or t
  misc_feature (21178495)..(21178514): n is a, c, g, or t
  misc_feature (21189000)..(21189041): n is a, c, g, or t
  misc_feature (21233048)..(21233158): n is a, c, g, or t
  misc_feature (21269516)..(21269608): n is a, c, g, or t
  misc_feature (21367232)..(21367238): n is a, c, g, or t
  misc_feature (21390578)..(21390580): n is a, c, g, or t
  misc_feature (21488338)..(21488338): n is a, c, g, or t
  misc_feature (22029283)..(22029290): n is a, c, g, or t
  misc_feature (22202447)..(22202449): n is a, c, g, or t
  misc_feature (23967734)..(23967738): n is a, c, g, or t
  misc_feature (24077668)..(24077668): n is a, c, g, or t
  misc_feature (24108910)..(24108921): n is a, c, g, or t
  misc_feature (24560700)..(24560724): n is a, c, g, or t
  misc_feature (24571255)..(24571272): n is a, c, g, or t
  misc_feature (25962142)..(25962161): n is a, c, g, or t
  misc_feature (26014865)..(26014909): n is a, c, g, or t
  misc_feature (26163349)..(26163351): n is a, c, g, or t
  misc_feature (26228782)..(26228782): n is a, c, g, or t
  misc_feature (26859120)..(26859120): n is a, c, g, or t
  misc_feature (27465019)..(27465042): n is a, c, g, or t
  misc_feature (27843838)..(27843858): n is a, c, g, or t
  misc_feature (27859213)..(27859213): n is a, c, g, or t
  misc_feature (27860086)..(27860086): n is a, c, g, or t
  misc_feature (29166646)..(29166646): n is a, c, g, or t
  misc_feature (29203147)..(29203147): n is a, c, g, or t
  misc_feature (29377653)..(29377653): n is a, c, g, or t
  misc_feature (29389167)..(29389167): n is a, c, g, or t
  misc_feature (29389532)..(29389532): n is a, c, g, or t
  misc_feature (29954172)..(29954176): n is a, c, g, or t
  misc_feature (30475823)..(30475836): n is a, c, g, or t
  misc_feature (31100878)..(31100878): n is a, c, g, or t
  misc_feature (31112152)..(31112180): n is a, c, g, or t
  misc_feature (31177709)..(31177859): n is a, c, g, or t
  misc_feature (31204353)..(31204376): n is a, c, g, or t
  misc_feature (31218238)..(31218269): n is a, c, g, or t
  misc_feature (31263223)..(31263243): n is a, c, g, or t
  misc_feature (31266759)..(31266759): n is a, c, g, or t
  misc_feature (31598712)..(31598712): n is a, c, g, or t
  misc_feature (31720769)..(31720846): n is a, c, g, or t
  misc_feature (31734313)..(31734466): n is a, c, g, or t
  misc_feature (31887307)..(31887307): n is a, c, g, or t
  misc_feature (31997037)..(31997037): n is a, c, g, or t
  misc_feature (32222116)..(32222118): n is a, c, g, or t
  misc_feature (32354795)..(32354795): n is a, c, g, or t
  misc_feature (32513372)..(32513372): n is a, c, g, or t
  misc_feature (32516439)..(32516453): n is a, c, g, or t
  misc_feature (33790664)..(33790691): n is a, c, g, or t
  misc_feature (33920149)..(33920190): n is a, c, g, or t
  misc_feature (34021515)..(34021564): n is a, c, g, or t
  misc_feature (34027227)..(34027276): n is a, c, g, or t
  misc_feature (34033950)..(34033950): n is a, c, g, or t
  misc_feature (34034596)..(34034645): n is a, c, g, or t
  misc_feature (34036294)..(34036294): n is a, c, g, or t
  misc_feature (34036837)..(34036886): n is a, c, g, or t
  misc_feature (34062605)..(34062654): n is a, c, g, or t
  misc_feature (34062890)..(34062939): n is a, c, g, or t
  misc_feature (34063442)..(34063502): n is a, c, g, or t
  misc_feature (34064299)..(34064348): n is a, c, g, or t
  misc_feature (34064685)..(34064685): n is a, c, g, or t
  misc_feature (34064944)..(34064993): n is a, c, g, or t
  misc_feature (34065663)..(34065822): n is a, c, g, or t
  misc_feature (34067235)..(34067284): n is a, c, g, or t
  misc_feature (34231907)..(34231907): n is a, c, g, or t
  misc_feature (34232109)..(34232158): n is a, c, g, or t
  misc_feature (34232405)..(34232405): n is a, c, g, or t
  misc_feature (34232639)..(34232688): n is a, c, g, or t
  misc_feature (34234134)..(34234183): n is a, c, g, or t
  misc_feature (34234416)..(34234465): n is a, c, g, or t
  misc_feature (34234718)..(34234740): n is a, c, g, or t
  misc_feature (34235808)..(34235808): n is a, c, g, or t
  misc_feature (34236013)..(34236117): n is a, c, g, or t
  misc_feature (34236683)..(34236732): n is a, c, g, or t
  misc_feature (34236978)..(34237027): n is a, c, g, or t
  misc_feature (34237259)..(34237259): n is a, c, g, or t
  misc_feature (34237527)..(34237576): n is a, c, g, or t
  misc_feature (34243863)..(34243912): n is a, c, g, or t
  misc_feature (34244121)..(34244186): n is a, c, g, or t
  misc_feature (34263184)..(34263349): n is a, c, g, or t
  misc_feature (34264167)..(34264208): n is a, c, g, or t
  misc_feature (34265193)..(34265242): n is a, c, g, or t
  misc_feature (34266178)..(34266227): n is a, c, g, or t
  misc_feature (34270752)..(34270801): n is a, c, g, or t
  misc_feature (34271040)..(34271089): n is a, c, g, or t
  misc_feature (34275451)..(34275500): n is a, c, g, or t
  misc_feature (34280267)..(34280316): n is a, c, g, or t
  misc_feature (34290277)..(34290277): n is a, c, g, or t
  misc_feature (34297336)..(34297336): n is a, c, g, or t
  misc_feature (34297596)..(34297645): n is a, c, g, or t
  misc_feature (34299425)..(34299585): n is a, c, g, or t
  misc_feature (34301363)..(34301441): n is a, c, g, or t
  misc_feature (34305766)..(34305815): n is a, c, g, or t
  misc_feature (34306081)..(34306130): n is a, c, g, or t
  misc_feature (34306365)..(34306414): n is a, c, g, or t
  misc_feature (34310328)..(34310328): n is a, c, g, or t
  misc_feature (34310554)..(34310603): n is a, c, g, or t
  misc_feature (34314743)..(34314792): n is a, c, g, or t
  misc_feature (34460208)..(34460257): n is a, c, g, or t
  misc_feature (34478331)..(34478331): n is a, c, g, or t
  misc_feature (34478534)..(34478590): n is a, c, g, or t
  misc_feature (34480765)..(34480765): n is a, c, g, or t
  misc_feature (34481043)..(34481092): n is a, c, g, or t
  misc_feature (34481522)..(34481571): n is a, c, g, or t
  misc_feature (34485079)..(34485128): n is a, c, g, or t
  misc_feature (34486762)..(34486811): n is a, c, g, or t
  misc_feature (34495182)..(34495182): n is a, c, g, or t
  misc_feature (34495386)..(34495435): n is a, c, g, or t
  misc_feature (34495865)..(34495914): n is a, c, g, or t
  misc_feature (34497067)..(34497084): n is a, c, g, or t
  misc_feature (34748425)..(34748474): n is a, c, g, or t
  misc_feature (34748800)..(34748848): n is a, c, g, or t
  misc_feature (35159653)..(35159653): n is a, c, g, or t
  misc_feature (35162792)..(35162971): n is a, c, g, or t
  misc_feature (35164108)..(35164159): n is a, c, g, or t
  misc_feature (35164681)..(35164730): n is a, c, g, or t
  misc_feature (35167996)..(35168105): n is a, c, g, or t
  misc_feature (35169110)..(35169159): n is a, c, g, or t
  misc_feature (35170362)..(35170362): n is a, c, g, or t
  misc_feature (35170687)..(35170736): n is a, c, g, or t
  misc_feature (35176251)..(35176355): n is a, c, g, or t
  misc_feature (35176926)..(35176975): n is a, c, g, or t
  misc_feature (35177403)..(35177403): n is a, c, g, or t
  misc_feature (35177607)..(35177656): n is a, c, g, or t
  misc_feature (35184373)..(35184422): n is a, c, g, or t
  misc_feature (35184904)..(35184904): n is a, c, g, or t
  misc_feature (35185279)..(35185328): n is a, c, g, or t
  misc_feature (35210065)..(35210065): n is a, c, g, or t
  misc_feature (35240548)..(35240548): n is a, c, g, or t
  misc_feature (35364083)..(35364106): n is a, c, g, or t
  misc_feature (35929649)..(35929800): n is a, c, g, or t
  misc_feature (35932668)..(35932717): n is a, c, g, or t
  misc_feature (35935994)..(35936043): n is a, c, g, or t
  misc_feature (36067652)..(36067652): n is a, c, g, or t
  misc_feature (36067874)..(36067923): n is a, c, g, or t
  misc_feature (36069205)..(36069205): n is a, c, g, or t
  misc_feature (36069464)..(36069513): n is a, c, g, or t
  misc_feature (36070405)..(36070454): n is a, c, g, or t
  misc_feature (36072042)..(36072091): n is a, c, g, or t
  misc_feature (36081279)..(36081328): n is a, c, g, or t
  misc_feature (36082250)..(36082360): n is a, c, g, or t
  misc_feature (36082923)..(36082972): n is a, c, g, or t
  misc_feature (36083419)..(36083435): n is a, c, g, or t
  misc_feature (36083853)..(36083853): n is a, c, g, or t
  misc_feature (36084074)..(36084123): n is a, c, g, or t
  misc_feature (36092718)..(36092718): n is a, c, g, or t
  misc_feature (36092982)..(36093059): n is a, c, g, or t
  misc_feature (36096616)..(36096640): n is a, c, g, or t
  misc_feature (36096738)..(36096738): n is a, c, g, or t
  misc_feature (36096992)..(36097041): n is a, c, g, or t
  misc_feature (36098465)..(36098465): n is a, c, g, or t
  misc_feature (36098757)..(36098806): n is a, c, g, or t
  misc_feature (36100772)..(36100772): n is a, c, g, or t
  misc_feature (36101051)..(36101100): n is a, c, g, or t
  misc_feature (36101306)..(36101306): n is a, c, g, or t
  misc_feature (36101564)..(36101613): n is a, c, g, or t
  misc_feature (36101835)..(36101835): n is a, c, g, or t
  misc_feature (36102079)..(36102157): n is a, c, g, or t
  misc_feature (36682299)..(36682348): n is a, c, g, or t
  misc_feature (36682604)..(36682653): n is a, c, g, or t
  misc_feature (36689683)..(36689732): n is a, c, g, or t
  misc_feature (36692431)..(36692480): n is a, c, g, or t
  misc_feature (36697373)..(36697373): n is a, c, g, or t
  misc_feature (36697677)..(36697726): n is a, c, g, or t
  misc_feature (36699812)..(36699812): n is a, c, g, or t
  misc_feature (36700209)..(36700258): n is a, c, g, or t
  misc_feature (36863034)..(36863065): n is a, c, g, or t
  misc_feature (37154011)..(37154024): n is a, c, g, or t
  misc_feature (37300828)..(37300877): n is a, c, g, or t
  misc_feature (37301501)..(37301550): n is a, c, g, or t
  misc_feature (37301772)..(37301772): n is a, c, g, or t
  misc_feature (37302087)..(37302136): n is a, c, g, or t
  misc_feature (37313512)..(37313512): n is a, c, g, or t
  misc_feature (37313733)..(37313782): n is a, c, g, or t
  misc_feature (37334743)..(37334743): n is a, c, g, or t
  misc_feature (37335086)..(37335135): n is a, c, g, or t
  misc_feature (37339864)..(37339864): n is a, c, g, or t
  misc_feature (37340073)..(37340122): n is a, c, g, or t
  misc_feature (37340671)..(37340720): n is a, c, g, or t
  misc_feature (37340961)..(37341064): n is a, c, g, or t
  misc_feature (37341375)..(37341424): n is a, c, g, or t
  misc_feature (37342687)..(37342687): n is a, c, g, or t
  misc_feature (37343949)..(37343998): n is a, c, g, or t
  misc_feature (37344604)..(37344604): n is a, c, g, or t
  misc_feature (37348936)..(37349009): n is a, c, g, or t
  misc_feature (37353682)..(37353802): n is a, c, g, or t
  misc_feature (37354047)..(37354096): n is a, c, g, or t
  misc_feature (37404163)..(37404212): n is a, c, g, or t
  misc_feature (37404462)..(37404511): n is a, c, g, or t
  misc_feature (37409635)..(37409635): n is a, c, g, or t
  misc_feature (37409882)..(37409931): n is a, c, g, or t
  misc_feature (37410497)..(37410546): n is a, c, g, or t
  misc_feature (37410844)..(37410893): n is a, c, g, or t
  misc_feature (37412342)..(37412342): n is a, c, g, or t
  misc_feature (37412565)..(37412614): n is a, c, g, or t
  misc_feature (37412850)..(37412850): n is a, c, g, or t
  misc_feature (37413087)..(37413136): n is a, c, g, or t
  misc_feature (37418649)..(37418649): n is a, c, g, or t
  misc_feature (37419828)..(37419877): n is a, c, g, or t
  misc_feature (37472476)..(37472480): n is a, c, g, or t
  misc_feature (37539526)..(37539539): n is a, c, g, or t
  misc_feature (37887342)..(37887342): n is a, c, g, or t
  misc_feature (38498636)..(38498638): n is a, c, g, or t
  misc_feature (38499508)..(38499557): n is a, c, g, or t
  misc_feature (38499825)..(38499874): n is a, c, g, or t
  misc_feature (38500624)..(38500673): n is a, c, g, or t
  misc_feature (38500972)..(38500972): n is a, c, g, or t
  misc_feature (38501225)..(38501274): n is a, c, g, or t
  misc_feature (38501623)..(38501623): n is a, c, g, or t
  misc_feature (38501824)..(38501873): n is a, c, g, or t
  misc_feature (38502434)..(38502434): n is a, c, g, or t
  misc_feature (38502681)..(38502734): n is a, c, g, or t
  misc_feature (38529582)..(38529582): n is a, c, g, or t
  misc_feature (38529810)..(38529886): n is a, c, g, or t
  misc_feature (38562440)..(38562440): n is a, c, g, or t
  misc_feature (38562928)..(38562977): n is a, c, g, or t
  misc_feature (38566706)..(38566755): n is a, c, g, or t
  misc_feature (38567188)..(38567237): n is a, c, g, or t
  misc_feature (38567475)..(38567524): n is a, c, g, or t
  misc_feature (38568632)..(38568632): n is a, c, g, or t
  misc_feature (38568863)..(38568912): n is a, c, g, or t
  misc_feature (38574067)..(38574116): n is a, c, g, or t
  misc_feature (38576744)..(38576859): n is a, c, g, or t
  misc_feature (38582306)..(38582491): n is a, c, g, or t
  misc_feature (38838603)..(38838603): n is a, c, g, or t
  misc_feature (38838848)..(38839043): n is a, c, g, or t
  misc_feature (38840383)..(38840383): n is a, c, g, or t
  misc_feature (38840584)..(38840633): n is a, c, g, or t
  misc_feature (38840900)..(38840900): n is a, c, g, or t
  misc_feature (38841140)..(38841189): n is a, c, g, or t
  misc_feature (38841863)..(38841863): n is a, c, g, or t
  misc_feature (38842075)..(38842124): n is a, c, g, or t
  misc_feature (38842348)..(38842348): n is a, c, g, or t
  misc_feature (38842582)..(38842631): n is a, c, g, or t
  misc_feature (38845694)..(38845743): n is a, c, g, or t
  misc_feature (38856447)..(38856496): n is a, c, g, or t
  misc_feature (38872256)..(38872256): n is a, c, g, or t
  misc_feature (38872705)..(38872754): n is a, c, g, or t
  misc_feature (38953405)..(38953409): n is a, c, g, or t
  misc_feature (38985368)..(38985368): n is a, c, g, or t
  misc_feature (38985682)..(38985731): n is a, c, g, or t
  misc_feature (38988632)..(38988632): n is a, c, g, or t
  misc_feature (38989078)..(38989127): n is a, c, g, or t
  misc_feature (39124540)..(39124582): n is a, c, g, or t
  misc_feature (39462568)..(39462617): n is a, c, g, or t
  misc_feature (39467549)..(39467549): n is a, c, g, or t
  misc_feature (39467753)..(39467802): n is a, c, g, or t
  misc_feature (39512225)..(39512227): n is a, c, g, or t
  misc_feature (39512322)..(39512322): n is a, c, g, or t
  misc_feature (39513122)..(39513171): n is a, c, g, or t
  misc_feature (39518598)..(39518598): n is a, c, g, or t
  misc_feature (39518803)..(39518852): n is a, c, g, or t
  misc_feature (39519308)..(39519357): n is a, c, g, or t
  misc_feature (39520199)..(39520248): n is a, c, g, or t
  misc_feature (39522531)..(39522531): n is a, c, g, or t
  misc_feature (39522764)..(39522764): n is a, c, g, or t
  misc_feature (39523101)..(39523150): n is a, c, g, or t
  misc_feature (39524022)..(39524022): n is a, c, g, or t
  misc_feature (39524237)..(39524286): n is a, c, g, or t
  misc_feature (39528072)..(39528072): n is a, c, g, or t
  misc_feature (39529672)..(39529721): n is a, c, g, or t
  misc_feature (39531579)..(39531579): n is a, c, g, or t
  misc_feature (39531784)..(39531833): n is a, c, g, or t
  misc_feature (39535545)..(39535545): n is a, c, g, or t
  misc_feature (39536852)..(39536901): n is a, c, g, or t
  misc_feature (39547133)..(39547133): n is a, c, g, or t
  misc_feature (39547421)..(39547470): n is a, c, g, or t
  misc_feature (39549142)..(39549232): n is a, c, g, or t
  misc_feature (39549654)..(39549716): n is a, c, g, or t
  misc_feature (39561911)..(39561922): n is a, c, g, or t
  misc_feature (39714619)..(39714668): n is a, c, g, or t
  misc_feature (39717606)..(39717606): n is a, c, g, or t
  misc_feature (39717874)..(39717928): n is a, c, g, or t
  misc_feature (39737340)..(39737422): n is a, c, g, or t
  misc_feature (39738084)..(39738133): n is a, c, g, or t
  misc_feature (39739478)..(39739527): n is a, c, g, or t
  misc_feature (39755184)..(39755233): n is a, c, g, or t
  misc_feature (39755474)..(39755556): n is a, c, g, or t
  misc_feature (39756808)..(39756808): n is a, c, g, or t
  misc_feature (39757076)..(39757152): n is a, c, g, or t
  misc_feature (39759363)..(39759412): n is a, c, g, or t
  misc_feature (39760067)..(39760116): n is a, c, g, or t
  misc_feature (39763175)..(39763175): n is a, c, g, or t
  misc_feature (39763381)..(39764484): n is a, c, g, or t
  misc_feature (39769986)..(39770157): n is a, c, g, or t
  misc_feature (39770931)..(39770991): n is a, c, g, or t
  misc_feature (39771820)..(39771946): n is a, c, g, or t
  misc_feature (39772149)..(39772149): n is a, c, g, or t
  misc_feature (39773226)..(39773226): n is a, c, g, or t
  misc_feature (39773460)..(39773509): n is a, c, g, or t
  misc_feature (39774303)..(39774303): n is a, c, g, or t
  misc_feature (39774536)..(39774585): n is a, c, g, or t
  misc_feature (39775573)..(39775573): n is a, c, g, or t
  misc_feature (39775880)..(39775929): n is a, c, g, or t
  misc_feature (39776580)..(39776629): n is a, c, g, or t
  misc_feature (39842017)..(39842114): n is a, c, g, or t
  misc_feature (39920733)..(39920733): n is a, c, g, or t
  misc_feature (39940147)..(39940196): n is a, c, g, or t
  misc_feature (39956615)..(39956615): n is a, c, g, or t
  misc_feature (39970725)..(39970774): n is a, c, g, or t
  misc_feature (39989394)..(39989394): n is a, c, g, or t
  misc_feature (40284366)..(40284415): n is a, c, g, or t
  misc_feature (40285876)..(40285876): n is a, c, g, or t
  misc_feature (40614874)..(40614923): n is a, c, g, or t
  misc_feature (40641594)..(40641594): n is a, c, g, or t
  misc_feature (40641923)..(40641923): n is a, c, g, or t
  misc_feature (40689276)..(40689348): n is a, c, g, or t
  misc_feature (40705218)..(40705267): n is a, c, g, or t
  misc_feature (40780980)..(40781029): n is a, c, g, or t
  misc_feature (40878859)..(40878859): n is a, c, g, or t
  misc_feature (40907436)..(40907436): n is a, c, g, or t
  misc_feature (40939935)..(40939984): n is a, c, g, or t
  misc_feature (41047689)..(41047689): n is a, c, g, or t
  misc_feature (41085017)..(41085066): n is a, c, g, or t
  misc_feature (41097600)..(41097600): n is a, c, g, or t
  misc_feature (41193529)..(41193532): n is a, c, g, or t
  misc_feature (41210596)..(41210597): n is a, c, g, or t
  misc_feature (41454254)..(41454254): n is a, c, g, or t
  misc_feature (41455190)..(41455239): n is a, c, g, or t
  misc_feature (41464964)..(41464964): n is a, c, g, or t
  misc_feature (41470137)..(41470186): n is a, c, g, or t
  misc_feature (41474829)..(41474878): n is a, c, g, or t
  misc_feature (41475130)..(41475179): n is a, c, g, or t
  misc_feature (41475389)..(41475464): n is a, c, g, or t
  misc_feature (41476193)..(41476193): n is a, c, g, or t
  misc_feature (41478132)..(41478181): n is a, c, g, or t
  misc_feature (41479843)..(41479892): n is a, c, g, or t
  misc_feature (41555467)..(41555467): n is a, c, g, or t
  misc_feature (41556805)..(41556854): n is a, c, g, or t
  misc_feature (41558771)..(41558771): n is a, c, g, or t
  misc_feature (41559758)..(41559807): n is a, c, g, or t
  misc_feature (41560011)..(41560046): n is a, c, g, or t
  misc_feature (41578146)..(41578146): n is a, c, g, or t
  misc_feature (41589023)..(41589072): n is a, c, g, or t
  misc_feature (41609568)..(41609617): n is a, c, g, or t
  misc_feature (41618331)..(41618398): n is a, c, g, or t
  misc_feature (41625746)..(41625882): n is a, c, g, or t
  misc_feature (41626482)..(41626576): n is a, c, g, or t
  misc_feature (41659037)..(41659037): n is a, c, g, or t
  misc_feature (41669189)..(41669238): n is a, c, g, or t
  misc_feature (41686082)..(41686214): n is a, c, g, or t
  misc_feature (41688125)..(41688174): n is a, c, g, or t
  misc_feature (41688576)..(41688625): n is a, c, g, or t
  misc_feature (41690214)..(41690263): n is a, c, g, or t
  misc_feature (41712579)..(41712579): n is a, c, g, or t
  misc_feature (42130267)..(42130267): n is a, c, g, or t
  misc_feature (42130585)..(42130634): n is a, c, g, or t
  misc_feature (42134256)..(42134325): n is a, c, g, or t
  misc_feature (42275262)..(42275262): n is a, c, g, or t
  misc_feature (42665266)..(42665282): n is a, c, g, or t
  misc_feature (42692785)..(42692807): n is a, c, g, or t
  misc_feature (42715068)..(42715083): n is a, c, g, or t
  misc_feature (42724057)..(42724074): n is a, c, g, or t
  misc_feature (42783171)..(42783171): n is a, c, g, or t
  misc_feature (42789276)..(42789375): n is a, c, g, or t
  misc_feature (42816840)..(42816929): n is a, c, g, or t
  misc_feature (42817270)..(42817319): n is a, c, g, or t
  misc_feature (42824981)..(42825030): n is a, c, g, or t
  misc_feature (42825231)..(42825280): n is a, c, g, or t
  misc_feature (42857192)..(42857241): n is a, c, g, or t
  misc_feature (42861151)..(42861200): n is a, c, g, or t
  misc_feature (42862104)..(42862155): n is a, c, g, or t
  misc_feature (42889151)..(42889200): n is a, c, g, or t
  misc_feature (42894035)..(42894035): n is a, c, g, or t
  misc_feature (42895733)..(42895804): n is a, c, g, or t
  misc_feature (42912361)..(42912410): n is a, c, g, or t
  misc_feature (42913543)..(42913592): n is a, c, g, or t
  misc_feature (42913841)..(42913890): n is a, c, g, or t
  misc_feature (42914530)..(42914579): n is a, c, g, or t
  misc_feature (42915142)..(42915191): n is a, c, g, or t
  misc_feature (42917068)..(42917068): n is a, c, g, or t
  misc_feature (42917638)..(42917687): n is a, c, g, or t
  misc_feature (42917999)..(42917999): n is a, c, g, or t
  misc_feature (42918415)..(42918464): n is a, c, g, or t
  misc_feature (42922303)..(42922303): n is a, c, g, or t
  misc_feature (43020711)..(43020736): n is a, c, g, or t
  misc_feature (43138158)..(43138199): n is a, c, g, or t
  misc_feature (43285903)..(43285910): n is a, c, g, or t
  misc_feature (43918474)..(43918484): n is a, c, g, or t
  misc_feature (44111898)..(44111947): n is a, c, g, or t
  misc_feature (44224860)..(44224869): n is a, c, g, or t
  misc_feature (44367954)..(44367954): n is a, c, g, or t
  misc_feature (44509331)..(44509353): n is a, c, g, or t
  misc_feature (44812599)..(44812599): n is a, c, g, or t
  misc_feature (44814011)..(44814060): n is a, c, g, or t
  misc_feature (44816890)..(44816890): n is a, c, g, or t
  misc_feature (44817515)..(44817618): n is a, c, g, or t
  misc_feature (44819113)..(44819113): n is a, c, g, or t
  misc_feature (44821645)..(44821695): n is a, c, g, or t
  misc_feature (44835619)..(44835619): n is a, c, g, or t
  misc_feature (44852140)..(44852203): n is a, c, g, or t
  misc_feature (44858104)..(44858153): n is a, c, g, or t
  misc_feature (44858355)..(44858455): n is a, c, g, or t
  misc_feature (44859891)..(44859891): n is a, c, g, or t
  misc_feature (44861274)..(44861323): n is a, c, g, or t
  misc_feature (44939342)..(44939342): n is a, c, g, or t
  misc_feature (45145777)..(45145799): n is a, c, g, or t
  misc_feature (45178245)..(45178245): n is a, c, g, or t
  misc_feature (45179749)..(45180150): n is a, c, g, or t
  misc_feature (45183682)..(45183732): n is a, c, g, or t
  misc_feature (45191153)..(45191202): n is a, c, g, or t
  misc_feature (45193248)..(45193248): n is a, c, g, or t
  misc_feature (45194579)..(45194679): n is a, c, g, or t
  misc_feature (45199094)..(45199094): n is a, c, g, or t
  misc_feature (45199791)..(45199840): n is a, c, g, or t
  misc_feature (45200382)..(45200382): n is a, c, g, or t
  misc_feature (45381079)..(45381167): n is a, c, g, or t
  misc_feature (45508079)..(45508128): n is a, c, g, or t
  misc_feature (45508880)..(45508929): n is a, c, g, or t
  misc_feature (45511685)..(45511734): n is a, c, g, or t
  misc_feature (45521589)..(45521638): n is a, c, g, or t
  misc_feature (45522735)..(45522784): n is a, c, g, or t
  misc_feature (45522999)..(45523048): n is a, c, g, or t
  misc_feature (45556881)..(45556930): n is a, c, g, or t
  misc_feature (45637359)..(45637408): n is a, c, g, or t
  misc_feature (45683703)..(45683703): n is a, c, g, or t
  misc_feature (45697862)..(45697911): n is a, c, g, or t
  misc_feature (45725301)..(45725350): n is a, c, g, or t
  misc_feature (45726284)..(45726333): n is a, c, g, or t
  misc_feature (45726622)..(45726671): n is a, c, g, or t
  misc_feature (45735683)..(45735683): n is a, c, g, or t
  misc_feature (45737800)..(45737849): n is a, c, g, or t
  misc_feature (45743546)..(45743546): n is a, c, g, or t
  misc_feature (45745825)..(45745874): n is a, c, g, or t
  misc_feature (45746091)..(45746091): n is a, c, g, or t
  misc_feature (45753724)..(45753773): n is a, c, g, or t
  misc_feature (45756973)..(45756973): n is a, c, g, or t
  misc_feature (45758505)..(45758554): n is a, c, g, or t
  misc_feature (45788143)..(45788143): n is a, c, g, or t
  misc_feature (45802503)..(45802503): n is a, c, g, or t
  misc_feature (46083991)..(46084096): n is a, c, g, or t
  misc_feature (46102916)..(46102965): n is a, c, g, or t
  misc_feature (46103167)..(46103216): n is a, c, g, or t
  misc_feature (46109258)..(46109307): n is a, c, g, or t
  misc_feature (46152221)..(46152235): n is a, c, g, or t
  misc_feature (46362499)..(46362499): n is a, c, g, or t
  misc_feature (46363494)..(46363543): n is a, c, g, or t
  misc_feature (46368231)..(46368280): n is a, c, g, or t
  misc_feature (46381356)..(46381405): n is a, c, g, or t
  misc_feature (46397811)..(46397860): n is a, c, g, or t
  misc_feature (46449717)..(46449769): n is a, c, g, or t
  misc_feature (46460075)..(46460159): n is a, c, g, or t
  misc_feature (46460553)..(46460602): n is a, c, g, or t
  misc_feature (46464367)..(46464416): n is a, c, g, or t
  misc_feature (46467864)..(46467913): n is a, c, g, or t
  misc_feature (46470073)..(46470166): n is a, c, g, or t
  misc_feature (46472256)..(46472256): n is a, c, g, or t
  misc_feature (46476636)..(46476742): n is a, c, g, or t
  misc_feature (46483600)..(46483649): n is a, c, g, or t
  misc_feature (46483891)..(46483940): n is a, c, g, or t
  misc_feature (46489942)..(46489991): n is a, c, g, or t
  misc_feature (46493579)..(46493628): n is a, c, g, or t
  misc_feature (46496964)..(46496964): n is a, c, g, or t
  misc_feature (46497326)..(46497375): n is a, c, g, or t
  misc_feature (46499939)..(46499988): n is a, c, g, or t
  misc_feature (46500296)..(46500368): n is a, c, g, or t
  misc_feature (46514171)..(46514171): n is a, c, g, or t
  misc_feature (46515328)..(46515377): n is a, c, g, or t
  misc_feature (46515593)..(46515593): n is a, c, g, or t
  misc_feature (46519671)..(46519720): n is a, c, g, or t
  misc_feature (46521429)..(46521429): n is a, c, g, or t
  misc_feature (46534680)..(46534820): n is a, c, g, or t
  misc_feature (46537987)..(46537987): n is a, c, g, or t
  misc_feature (46558003)..(46558052): n is a, c, g, or t
  misc_feature (46779598)..(46779647): n is a, c, g, or t
  misc_feature (46790276)..(46790325): n is a, c, g, or t
  misc_feature (46791525)..(46791525): n is a, c, g, or t
  misc_feature (46800289)..(46800338): n is a, c, g, or t
  misc_feature (46805256)..(46805256): n is a, c, g, or t
  misc_feature (46812509)..(46812558): n is a, c, g, or t
  misc_feature (46816694)..(46816694): n is a, c, g, or t
  misc_feature (46817194)..(46817243): n is a, c, g, or t
  misc_feature (46940655)..(46940655): n is a, c, g, or t
  misc_feature (46941331)..(46941380): n is a, c, g, or t
  misc_feature (46944598)..(46944598): n is a, c, g, or t
  misc_feature (46948116)..(46948165): n is a, c, g, or t
  misc_feature (46952525)..(46952574): n is a, c, g, or t
  misc_feature (46952744)..(46952813): n is a, c, g, or t
  misc_feature (46953095)..(46953144): n is a, c, g, or t
  misc_feature (46953738)..(46953787): n is a, c, g, or t
  misc_feature (46954092)..(46954141): n is a, c, g, or t
  misc_feature (46954391)..(46954440): n is a, c, g, or t
  misc_feature (46954673)..(46954722): n is a, c, g, or t
  misc_feature (46957857)..(46957906): n is a, c, g, or t
  misc_feature (46958923)..(46958972): n is a, c, g, or t
  misc_feature (46959775)..(46959824): n is a, c, g, or t
  misc_feature (47336074)..(47336074): n is a, c, g, or t
  misc_feature (47769204)..(47769253): n is a, c, g, or t
  misc_feature (47949992)..(47950010): n is a, c, g, or t
  misc_feature (48075208)..(48075216): n is a, c, g, or t
  misc_feature (48279155)..(48279204): n is a, c, g, or t
  misc_feature (48281879)..(48281879): n is a, c, g, or t
  misc_feature (48283636)..(48283685): n is a, c, g, or t
  misc_feature (48295442)..(48295491): n is a, c, g, or t
  misc_feature (48298142)..(48298191): n is a, c, g, or t
  misc_feature (48298912)..(48298961): n is a, c, g, or t
  misc_feature (48306832)..(48306832): n is a, c, g, or t
  misc_feature (48308251)..(48308293): n is a, c, g, or t
  misc_feature (48308497)..(48308546): n is a, c, g, or t
  misc_feature (48310544)..(48310544): n is a, c, g, or t
  misc_feature (48310960)..(48310960): n is a, c, g, or t
  misc_feature (48614152)..(48614201): n is a, c, g, or t
  misc_feature (49019941)..(49019941): n is a, c, g, or t
  misc_feature (49034046)..(49034095): n is a, c, g, or t
  misc_feature (49035397)..(49035397): n is a, c, g, or t
  misc_feature (49038653)..(49038702): n is a, c, g, or t
  misc_feature (49048594)..(49048643): n is a, c, g, or t
  misc_feature (49048864)..(49048918): n is a, c, g, or t
  misc_feature (49064229)..(49064278): n is a, c, g, or t
  misc_feature (49064758)..(49064879): n is a, c, g, or t
  misc_feature (49075016)..(49075069): n is a, c, g, or t
  misc_feature (49080643)..(49080717): n is a, c, g, or t
  misc_feature (49080946)..(49080995): n is a, c, g, or t
  misc_feature (49081288)..(49081337): n is a, c, g, or t
  misc_feature (49082727)..(49082727): n is a, c, g, or t
  misc_feature (49083960)..(49084010): n is a, c, g, or t
  misc_feature (49094466)..(49094515): n is a, c, g, or t
  misc_feature (49097699)..(49097748): n is a, c, g, or t
  misc_feature (49098088)..(49098137): n is a, c, g, or t
  misc_feature (49103831)..(49103831): n is a, c, g, or t
  misc_feature (49104387)..(49104436): n is a, c, g, or t
  misc_feature (49212384)..(49212384): n is a, c, g, or t
  misc_feature (49215580)..(49215629): n is a, c, g, or t
  misc_feature (49247521)..(49247521): n is a, c, g, or t
  misc_feature (49263219)..(49263268): n is a, c, g, or t
  misc_feature (49555926)..(49556044): n is a, c, g, or t
  misc_feature (49630888)..(49630937): n is a, c, g, or t
  misc_feature (49631231)..(49631305): n is a, c, g, or t
  misc_feature (49661552)..(49661552): n is a, c, g, or t
  misc_feature (50385665)..(50385665): n is a, c, g, or t
  misc_feature (50690479)..(50690479): n is a, c, g, or t
  misc_feature (50690679)..(50690679): n is a, c, g, or t
  misc_feature (50701364)..(50701413): n is a, c, g, or t
  misc_feature (50702110)..(50702110): n is a, c, g, or t
  misc_feature (50707317)..(50707483): n is a, c, g, or t
  misc_feature (50723022)..(50723022): n is a, c, g, or t
  misc_feature (50725035)..(50725084): n is a, c, g, or t
  misc_feature (50741922)..(50741971): n is a, c, g, or t
  misc_feature (50742893)..(50742942): n is a, c, g, or t
  misc_feature (50743433)..(50743433): n is a, c, g, or t
  misc_feature (50748403)..(50748452): n is a, c, g, or t
  misc_feature (50764816)..(50764902): n is a, c, g, or t
  misc_feature (50765114)..(50765163): n is a, c, g, or t
  misc_feature (50845954)..(50845954): n is a, c, g, or t
  misc_feature (50889359)..(50889387): n is a, c, g, or t
  misc_feature (50893037)..(50893086): n is a, c, g, or t
  misc_feature (50893412)..(50893412): n is a, c, g, or t
  misc_feature (50900776)..(50900825): n is a, c, g, or t
  misc_feature (50907347)..(50907347): n is a, c, g, or t
  misc_feature (50912683)..(50912732): n is a, c, g, or t
  misc_feature (51038242)..(51038339): n is a, c, g, or t
  misc_feature (51236302)..(51236351): n is a, c, g, or t
  misc_feature (51237052)..(51237052): n is a, c, g, or t
  misc_feature (51238377)..(51238426): n is a, c, g, or t
  misc_feature (51239089)..(51239089): n is a, c, g, or t
  misc_feature (51241769)..(51241818): n is a, c, g, or t
  misc_feature (51243484)..(51243484): n is a, c, g, or t
  misc_feature (51309569)..(51309618): n is a, c, g, or t
  misc_feature (51331944)..(51331944): n is a, c, g, or t
  misc_feature (51485449)..(51485498): n is a, c, g, or t
  misc_feature (51602850)..(51602851): n is a, c, g, or t
  misc_feature (52004728)..(52004728): n is a, c, g, or t
  misc_feature (52015515)..(52015515): n is a, c, g, or t
  misc_feature (52019477)..(52019526): n is a, c, g, or t
  misc_feature (52019845)..(52019845): n is a, c, g, or t
  misc_feature (52021812)..(52021942): n is a, c, g, or t
  misc_feature (52022704)..(52022704): n is a, c, g, or t
  misc_feature (52026565)..(52026614): n is a, c, g, or t
  misc_feature (52048644)..(52048693): n is a, c, g, or t
  misc_feature (52048878)..(52049012): n is a, c, g, or t
  misc_feature (52049402)..(52049466): n is a, c, g, or t
  misc_feature (52178151)..(52178227): n is a, c, g, or t
  misc_feature (52187685)..(52187688): n is a, c, g, or t
  misc_feature (52190057)..(52190061): n is a, c, g, or t
  misc_feature (52285607)..(52285656): n is a, c, g, or t
  misc_feature (52285993)..(52286042): n is a, c, g, or t
  misc_feature (52289007)..(52289077): n is a, c, g, or t
  misc_feature (52290263)..(52290312): n is a, c, g, or t
  misc_feature (52293110)..(52293136): n is a, c, g, or t
  misc_feature (52293381)..(52293430): n is a, c, g, or t
  misc_feature (52300941)..(52300990): n is a, c, g, or t
  misc_feature (52428849)..(52428853): n is a, c, g, or t
  misc_feature (52442428)..(52442477): n is a, c, g, or t
  misc_feature (52654493)..(52654542): n is a, c, g, or t
  misc_feature (52654847)..(52654896): n is a, c, g, or t
  misc_feature (52655611)..(52655660): n is a, c, g, or t
  misc_feature (52793697)..(52793717): n is a, c, g, or t
  misc_feature (52796751)..(52796800): n is a, c, g, or t
  misc_feature (52802476)..(52802525): n is a, c, g, or t
  misc_feature (53018531)..(53018531): n is a, c, g, or t
  misc_feature (53021249)..(53021298): n is a, c, g, or t
  misc_feature (53057063)..(53057112): n is a, c, g, or t
  misc_feature (53173878)..(53173903): n is a, c, g, or t
  misc_feature (53612422)..(53612471): n is a, c, g, or t
  misc_feature (53695822)..(53695838): n is a, c, g, or t
  misc_feature (54259020)..(54259064): n is a, c, g, or t
  misc_feature (54288602)..(54288602): n is a, c, g, or t
  misc_feature (54289777)..(54289826): n is a, c, g, or t
  misc_feature (54290242)..(54290291): n is a, c, g, or t
  misc_feature (54302128)..(54302128): n is a, c, g, or t
  misc_feature (54304521)..(54304570): n is a, c, g, or t
  misc_feature (54308597)..(54308646): n is a, c, g, or t
  misc_feature (54309268)..(54309342): n is a, c, g, or t
  misc_feature (54309855)..(54309904): n is a, c, g, or t
  misc_feature (54310108)..(54310157): n is a, c, g, or t
  misc_feature (54310576)..(54310576): n is a, c, g, or t
  misc_feature (54324787)..(54324836): n is a, c, g, or t
  misc_feature (54325598)..(54325598): n is a, c, g, or t
  misc_feature (54326212)..(54326261): n is a, c, g, or t
  misc_feature (54326485)..(54326485): n is a, c, g, or t
  misc_feature (54327006)..(54327006): n is a, c, g, or t
  misc_feature (55175746)..(55175752): n is a, c, g, or t
  misc_feature (55336349)..(55336370): n is a, c, g, or t
  misc_feature (55343389)..(55343390): n is a, c, g, or t
  misc_feature (55412216)..(55412216): n is a, c, g, or t
  misc_feature (55430238)..(55430238): n is a, c, g, or t
  misc_feature (55438748)..(55438849): n is a, c, g, or t
  misc_feature (55461152)..(55461152): n is a, c, g, or t
  misc_feature (55461834)..(55461883): n is a, c, g, or t
  misc_feature (55665121)..(55665176): n is a, c, g, or t
  misc_feature (55665929)..(55665978): n is a, c, g, or t
  misc_feature (55695277)..(55695277): n is a, c, g, or t
  misc_feature (55871267)..(55871305): n is a, c, g, or t
  misc_feature (55958135)..(55958151): n is a, c, g, or t
  misc_feature (55958385)..(55958385): n is a, c, g, or t
  misc_feature (56042796)..(56042845): n is a, c, g, or t
  misc_feature (56066211)..(56066314): n is a, c, g, or t
  misc_feature (56157319)..(56157326): n is a, c, g, or t
  misc_feature (56359196)..(56359196): n is a, c, g, or t
  misc_feature (56807737)..(56807764): n is a, c, g, or t
  misc_feature (56992773)..(56992773): n is a, c, g, or t
  misc_feature (56993104)..(56993104): n is a, c, g, or t
  misc_feature (56994993)..(56995042): n is a, c, g, or t
  misc_feature (57056425)..(57056425): n is a, c, g, or t
  misc_feature (57058109)..(57058158): n is a, c, g, or t
  misc_feature (57090109)..(57090158): n is a, c, g, or t
  misc_feature (57091922)..(57091971): n is a, c, g, or t
  misc_feature (57108771)..(57108771): n is a, c, g, or t
  misc_feature (57111261)..(57111351): n is a, c, g, or t
  misc_feature (57116253)..(57116302): n is a, c, g, or t
  misc_feature (57119071)..(57119120): n is a, c, g, or t
  misc_feature (57119329)..(57119378): n is a, c, g, or t
  misc_feature (57121759)..(57121759): n is a, c, g, or t
  misc_feature (57186012)..(57186012): n is a, c, g, or t
  misc_feature (57198037)..(57198037): n is a, c, g, or t
  misc_feature (57282139)..(57282139): n is a, c, g, or t
  misc_feature (57364932)..(57364981): n is a, c, g, or t
  misc_feature (57555332)..(57555332): n is a, c, g, or t
  misc_feature (57650790)..(57650790): n is a, c, g, or t
  misc_feature (57652001)..(57652066): n is a, c, g, or t
  misc_feature (57659281)..(57659281): n is a, c, g, or t
  misc_feature (57660824)..(57660873): n is a, c, g, or t
  misc_feature (57662100)..(57662100): n is a, c, g, or t
  misc_feature (57675042)..(57675091): n is a, c, g, or t
  misc_feature (57862977)..(57862977): n is a, c, g, or t
  misc_feature (57863942)..(57863991): n is a, c, g, or t
  misc_feature (57869572)..(57869572): n is a, c, g, or t
  misc_feature (57872680)..(57872729): n is a, c, g, or t
  misc_feature (58113365)..(58113365): n is a, c, g, or t
  misc_feature (58189326)..(58189326): n is a, c, g, or t
  misc_feature (58213371)..(58213376): n is a, c, g, or t
  misc_feature (58436030)..(58436030): n is a, c, g, or t
  misc_feature (58436462)..(58436511): n is a, c, g, or t
  misc_feature (58446592)..(58446641): n is a, c, g, or t
  misc_feature (58446898)..(58446978): n is a, c, g, or t
  misc_feature (58451975)..(58452656): n is a, c, g, or t
  misc_feature (58454547)..(58454596): n is a, c, g, or t
  misc_feature (58455705)..(58455754): n is a, c, g, or t
  misc_feature (58456018)..(58456067): n is a, c, g, or t
  misc_feature (58456326)..(58456375): n is a, c, g, or t
  misc_feature (58456581)..(58456630): n is a, c, g, or t
  misc_feature (58457888)..(58457888): n is a, c, g, or t
  misc_feature (58458794)..(58458843): n is a, c, g, or t
  misc_feature (58509181)..(58509230): n is a, c, g, or t
  misc_feature (58511946)..(58511946): n is a, c, g, or t
  misc_feature (58512772)..(58512821): n is a, c, g, or t
  misc_feature (58515129)..(58516137): n is a, c, g, or t
  misc_feature (58517923)..(58517972): n is a, c, g, or t
  misc_feature (58520075)..(58520189): n is a, c, g, or t
  misc_feature (58521792)..(58521792): n is a, c, g, or t
  misc_feature (58523889)..(58523938): n is a, c, g, or t
  misc_feature (58536820)..(58536886): n is a, c, g, or t
  misc_feature (58542153)..(58542202): n is a, c, g, or t
  misc_feature (58545256)..(58545403): n is a, c, g, or t
  misc_feature (58557304)..(58557353): n is a, c, g, or t
  misc_feature (58579539)..(58579539): n is a, c, g, or t
  misc_feature (58582947)..(58582996): n is a, c, g, or t
  misc_feature (58585228)..(58585228): n is a, c, g, or t
  misc_feature (58586780)..(58586838): n is a, c, g, or t
  misc_feature (58595308)..(58595308): n is a, c, g, or t
  misc_feature (58596100)..(58596149): n is a, c, g, or t
  misc_feature (58600231)..(58600319): n is a, c, g, or t
  misc_feature (58605994)..(58606043): n is a, c, g, or t
  misc_feature (58606247)..(58606296): n is a, c, g, or t
  misc_feature (58620693)..(58620793): n is a, c, g, or t
  misc_feature (58651779)..(58651779): n is a, c, g, or t
  misc_feature (58653547)..(58653596): n is a, c, g, or t
  misc_feature (58697577)..(58697626): n is a, c, g, or t
  misc_feature (58921196)..(58921217): n is a, c, g, or t
  misc_feature (59391831)..(59391831): n is a, c, g, or t
  misc_feature (59392654)..(59392810): n is a, c, g, or t
  misc_feature (59394063)..(59394063): n is a, c, g, or t
  misc_feature (59394164)..(59394166): n is a, c, g, or t
  misc_feature (59394742)..(59394762): n is a, c, g, or t
  misc_feature (59464971)..(59465020): n is a, c, g, or t
  misc_feature (59465115)..(59465265): n is a, c, g, or t
  misc_feature (59466634)..(59466634): n is a, c, g, or t
  misc_feature (59713212)..(59713261): n is a, c, g, or t
  misc_feature (59814087)..(59814087): n is a, c, g, or t
  misc_feature (59814738)..(59814824): n is a, c, g, or t
  misc_feature (59902994)..(59902994): n is a, c, g, or t
  misc_feature (59906866)..(59906915): n is a, c, g, or t
  misc_feature (59917061)..(59917061): n is a, c, g, or t
  misc_feature (59923987)..(59924036): n is a, c, g, or t
  misc_feature (59928165)..(59928214): n is a, c, g, or t
  misc_feature (59929039)..(59929088): n is a, c, g, or t
  misc_feature (60135434)..(60135483): n is a, c, g, or t
  misc_feature (60386895)..(60386944): n is a, c, g, or t
  misc_feature (60399184)..(60399265): n is a, c, g, or t
  misc_feature (60427016)..(60427109): n is a, c, g, or t
  misc_feature (60430645)..(60430645): n is a, c, g, or t
  misc_feature (60432277)..(60432326): n is a, c, g, or t
  misc_feature (60444636)..(60444685): n is a, c, g, or t
  misc_feature (60444907)..(60444956): n is a, c, g, or t
  misc_feature (60447185)..(60447185): n is a, c, g, or t
  misc_feature (60448685)..(60448734): n is a, c, g, or t
  misc_feature (60461699)..(60461699): n is a, c, g, or t
  misc_feature (60462549)..(60462598): n is a, c, g, or t
  misc_feature (60473448)..(60473497): n is a, c, g, or t
  misc_feature (60478924)..(60478973): n is a, c, g, or t
  misc_feature (60481758)..(60481807): n is a, c, g, or t
  misc_feature (60486917)..(60486917): n is a, c, g, or t
  misc_feature (60658670)..(60658713): n is a, c, g, or t
  misc_feature (61191181)..(61191230): n is a, c, g, or t
  misc_feature (61226428)..(61226477): n is a, c, g, or t
  misc_feature (61227157)..(61227206): n is a, c, g, or t
  misc_feature (61228028)..(61228173): n is a, c, g, or t
  misc_feature (61229861)..(61229861): n is a, c, g, or t
  misc_feature (61439426)..(61439486): n is a, c, g, or t
  misc_feature (61738577)..(61738577): n is a, c, g, or t
  misc_feature (61753473)..(61753475): n is a, c, g, or t
  misc_feature (61754599)..(61754648): n is a, c, g, or t
  misc_feature (61755021)..(61755021): n is a, c, g, or t
  misc_feature (61755746)..(61755795): n is a, c, g, or t
  misc_feature (61756774)..(61756844): n is a, c, g, or t
  misc_feature (61767200)..(61767315): n is a, c, g, or t
  misc_feature (61767533)..(61767673): n is a, c, g, or t
  misc_feature (62044093)..(62044142): n is a, c, g, or t
  misc_feature (62244010)..(62244015): n is a, c, g, or t
  misc_feature (62246831)..(62246880): n is a, c, g, or t
  misc_feature (62255413)..(62255462): n is a, c, g, or t
  misc_feature (62264304)..(62264304): n is a, c, g, or t
  misc_feature (62325388)..(62325437): n is a, c, g, or t
  misc_feature (62557043)..(62557043): n is a, c, g, or t
  misc_feature (62557779)..(62557828): n is a, c, g, or t
  misc_feature (62558631)..(62558650): n is a, c, g, or t
  misc_feature (62559274)..(62559395): n is a, c, g, or t
  misc_feature (62560653)..(62560751): n is a, c, g, or t
  misc_feature (62569070)..(62569070): n is a, c, g, or t
  misc_feature (62570387)..(62570389): n is a, c, g, or t
  misc_feature (62574780)..(62574829): n is a, c, g, or t
  misc_feature (62586898)..(62586947): n is a, c, g, or t
  misc_feature (62589043)..(62589131): n is a, c, g, or t
  misc_feature (62589638)..(62589687): n is a, c, g, or t
  misc_feature (62590271)..(62590337): n is a, c, g, or t
  misc_feature (62592974)..(62593085): n is a, c, g, or t
  misc_feature (62593535)..(62593535): n is a, c, g, or t
  misc_feature (62595430)..(62595430): n is a, c, g, or t
  misc_feature (62602255)..(62602373): n is a, c, g, or t
  misc_feature (62632077)..(62632126): n is a, c, g, or t
  misc_feature (62632639)..(62632639): n is a, c, g, or t
  misc_feature (62649674)..(62649674): n is a, c, g, or t
  misc_feature (62652902)..(62653006): n is a, c, g, or t
  misc_feature (62661587)..(62661636): n is a, c, g, or t
  misc_feature (62665533)..(62665582): n is a, c, g, or t
  misc_feature (62665934)..(62665934): n is a, c, g, or t
  misc_feature (62666484)..(62666533): n is a, c, g, or t
  misc_feature (62667073)..(62667073): n is a, c, g, or t
  misc_feature (62669020)..(62669069): n is a, c, g, or t
  misc_feature (62673469)..(62673493): n is a, c, g, or t
  misc_feature (62673949)..(62674048): n is a, c, g, or t
  misc_feature (62696077)..(62696077): n is a, c, g, or t
  misc_feature (62696632)..(62696703): n is a, c, g, or t
  misc_feature (62707797)..(62707797): n is a, c, g, or t
  misc_feature (62708403)..(62708452): n is a, c, g, or t
  misc_feature (62719096)..(62719145): n is a, c, g, or t
  misc_feature (62720176)..(62720225): n is a, c, g, or t
  misc_feature (62720426)..(62720426): n is a, c, g, or t
  misc_feature (62737768)..(62737768): n is a, c, g, or t
  misc_feature (62739873)..(62739922): n is a, c, g, or t
  misc_feature (62746534)..(62746583): n is a, c, g, or t
  misc_feature (62747156)..(62747205): n is a, c, g, or t
  misc_feature (62749136)..(62749269): n is a, c, g, or t
  misc_feature (62750296)..(62750345): n is a, c, g, or t
  misc_feature (62755059)..(62755059): n is a, c, g, or t
  misc_feature (62760563)..(62760612): n is a, c, g, or t
  misc_feature (62763197)..(62763197): n is a, c, g, or t
  misc_feature (62763427)..(62763476): n is a, c, g, or t
  misc_feature (62768449)..(62768449): n is a, c, g, or t
  misc_feature (62769213)..(62769271): n is a, c, g, or t
  misc_feature (62796402)..(62796402): n is a, c, g, or t
  misc_feature (62798293)..(62799030): n is a, c, g, or t
  misc_feature (62802879)..(62802879): n is a, c, g, or t
  misc_feature (62808918)..(62808967): n is a, c, g, or t
  misc_feature (62812625)..(62812625): n is a, c, g, or t
  misc_feature (62813183)..(62813232): n is a, c, g, or t
  misc_feature (62843242)..(62843349): n is a, c, g, or t
  misc_feature (62843585)..(62843634): n is a, c, g, or t
  misc_feature (62858536)..(62858646): n is a, c, g, or t
  misc_feature (62859116)..(62859208): n is a, c, g, or t
  misc_feature (62864786)..(62864786): n is a, c, g, or t
  misc_feature (62870461)..(62870510): n is a, c, g, or t
  misc_feature (62878333)..(62878382): n is a, c, g, or t
  misc_feature (62912961)..(62912961): n is a, c, g, or t
  misc_feature (63123687)..(63123736): n is a, c, g, or t
  misc_feature (63132040)..(63132042): n is a, c, g, or t
  misc_feature (63138997)..(63139046): n is a, c, g, or t
  misc_feature (63141728)..(63141728): n is a, c, g, or t
  misc_feature (63155642)..(63155691): n is a, c, g, or t
  misc_feature (63156204)..(63156204): n is a, c, g, or t
  misc_feature (63158857)..(63159032): n is a, c, g, or t
  misc_feature (63160081)..(63160195): n is a, c, g, or t
  misc_feature (63163164)..(63163164): n is a, c, g, or t
  misc_feature (63164792)..(63164841): n is a, c, g, or t
  misc_feature (63167130)..(63167130): n is a, c, g, or t
  misc_feature (63168593)..(63168642): n is a, c, g, or t
  misc_feature (63189372)..(63189372): n is a, c, g, or t
  misc_feature (63201843)..(63201892): n is a, c, g, or t
  misc_feature (63221239)..(63221239): n is a, c, g, or t
  misc_feature (63223532)..(63223634): n is a, c, g, or t
  misc_feature (63227341)..(63227341): n is a, c, g, or t
  misc_feature (63230218)..(63230267): n is a, c, g, or t
  misc_feature (63231327)..(63231327): n is a, c, g, or t
  misc_feature (63233685)..(63233734): n is a, c, g, or t
  misc_feature (63238574)..(63238574): n is a, c, g, or t
  misc_feature (63240329)..(63240378): n is a, c, g, or t
acagggttgttttggatcttgtaattggaatgagtacaatttaaatcccttaacgaggaacaattggagggcaagtctggtgccagcaaatgtgcgttcaaagattcgatgattcactgaattctgcaattcacattacttatcgcatttcgctgcgttcttcatcgctgccagaaccaagagatccgagataaaccactagagattattcaagctgactgtgatatattagcatcatatgccttgacatcctgtaagagcaagtcttcctagccttcaccgcacagggcgatgagctgcaacaggtctcagatgcagctctgaaagcagagatgcttatctgctagagataaaccactagagattattcaagctgactgtgatatattagcatcatatgccttgacatcctgtaagagcaagtcgtcctagccttcaccgcagaagacggagagttcgtatagattgcccaacacgatacaccacgacgctatcgttgtagataaagctagtgcaaacagcaatcgcagacagcaaccatgggcgagctgttctcactgcaatagtccgctttacaagagacctccaagatctagcgtctgaacccgggttgacggagaatggtgcataggtctagattggttagtgaaagttgtacccaatagaaattatcgactaacccacgtccaaccgctgttcacatggaacctttccccacttcggtccttcaagttctcattgaagtatttgcgcttatactattaagataatagttagatttattattattattattatctttatagttatatatatataaatagagctgtaaattatagtattactttataaattatattattcttatataacaggtaccgagaaaaccctcagtctccacagtatttattactaaatcttagatagaaattattggctggcttggggtggatgaagtcgtagtcttaaccataaactatgccgactagggatcggacgatgttaaaaattgactcgttcggcaccttacgagaaagcaaagtgcttgggctccagggggagtatggtcgcaaggctgaaacttaaagaaattgacggaagggcaccaccaggggtcgtcttagcaggcgattactctacggtactagaagtgtgctgtagtatttcgcgtattgtaattttaaaacgagcgggggcaaatcctttgcagacgacttagctgtgcgaaacggtcctgtaagcagtagagtagccttgttgttacgatctgctgagatatatataaagctcgagaagctcagaggttgagcggaacgttgaagttgtttaggtcgtgagttcgaatcccaccttgagcataattatgttattctatatcatttcttataaaaatataattatataaaaacttttgtgctataaatcagcatgaaaatatatataaagctcgagaagctcagaggttgagcggaacgttgaagttgtttaggtcgtgagttcgaatcccaccttgtgcataattatgttattctatatcatttcttataaaaatataattatataaaaacttttgtgctataaatcagcatgaaacagaatacaactttgccattgaggtctgggtaggtcgcgaagctagcttcctcgacgacgacatggttgccatcggtgttgccatttgcggtagcatgaagagatccagctgggaagtatcaaggtactttttgatgagctgatgaataccctcgcctcgagacgtaaccacatttttgacattgtgagatttgaaaacttcctggactttagtggtggtagaggatagacttaaggtctgcgtgccattctcgactttaagactatacgttttgacgcaaaaatggagcagaatctcaatggctctgtagctactgctaccaccggctcgacgattattgtagatcatgaagagcttcacgatagtggcgagtccatcgcaatgctatgttttaattagacagtcagattccccttgtccgtaccagttctaagttggttgttaaccgtacgccggtcgcaaggctgaaacttaaagaaattgacggaagggcaccaccaggggtggagcctgcggcttaatttgactcaacacggggatttcaacaatttcacgtactttttaaccctcttttcaaagtgcttttcatctttcgatcactctacttgtgcgctatcgttctctggccggtatttagctttagaagacgtatacctcccatttagagcagcattcccaaactactcgactcgtcgaagtggcttaggatcgactaacccacgtccaaccgctgttcacatggaacctttccccacttcggtccttcaagttctcatttaagtatttgctactaccaccaagatctctaagaacggccatgcaccaccacccacaaaatcaagaaagagctctcaatctgtcaatcctcattgtgtctggacctgatgagtattaggttaatattaaatctgtattattcctaataaaaaccttctatagtagtaaatatatactatacttatagaggtaaattgtgcatgtgctgtggttggatttgtggtggtgcatgcacgctgtggtggaatttacagtggcgtgcattcgctgtggtgggatttgtggtggtgtgggtgcgctgtggttgattatgtagtgggttgggtgcgctggggttggctcgctggctccgtcagtgtagcgcgcgtgcggcccagaacatctaagggcatcacagacctgttattgcctcaaacttcctaatagttaaatagaatatttaaattaaactctggaataatacttataagtatatattaactataaatagaataattagatataattactactaatagtataaattatatataatagtttagtataagaattaatctaactattactaatatatataaactatagtcgccgtataattgcttatacttagacatgcatggcttaatctttgagacaagcatatgactactggcagaatcaaccatgtaactatcgttcgccggggtgaaataccactactcctattgtttttttacttattcaatgaagcggggctggatttacgtccaacttctggttttaagttgtgcgttcaaagattcgatgattcactgaattctgcaattcacattacttatcgcatttcgctgcgttcttcatcgatgcgcccttatgacccgaggggctcttatgacggctcttttgaccggattcttgaatggtcagaggctatacaagcagcttctcttcgatactggactccaggtacaaatatagctataggttagtcttttatgcttgctagcatagcttgcgctagcgctacacaaaaataaatataaataaatatgaagaatattattcctattaaatttgttgtccactcggttatcgtcaatttctgtcctcatcaatgtttaccggaacattagttaaagtcaatatccatccgcacccccgataggctgtcagaatttccgcacccgacgccgctcatcattggctagatttccgagctgcatcacagattcgagaagttatcatgaatcaccagagagccccgaagggcattggtttttaatctaataaatacatcccttccgaagtccctgaaaatggatggcgctcaagcgtctcacccatacctcgccctcagggtagaaacgatgccctgaggagtaggcggccgtggaggtcagtgacgaagcctagggcgtgagcccgggttgaacggcctctagtgcagatcttggtggtagtagcaaacaataaatccaagaatttcacctctgacaattgaatactgatgcccccgactgtccctattaatcattacggcggtcctcgaaaccaacaaaatagaaccacacgtcctattttattattccatgctaatgtattcgagcaaaggcctgcctggagcacatagctctgctggtggcccggacccctgagggttcctagggcccgctaagccgtagcggtcatagcgggctgtagccaccgacccacagtggctgcagccgctattggttagtgatcgtaatcgctatcagatagcgatctcaatcgctattggctagcagttagtggttatgaccgctagtagcagccaaaaccccactaatttatagaggctataacctctctaaaatcaacactagagaagagaaattaaggtagctatctaagctatagataggcttctataggattaagaggaactatatagatatctattactgatatatattatagagctagtactatatattgttgaaattacagtggccttcaaggtgtattgggccttgagaccgctataacgcagcagggaagttcgctatattgttcgatcgataatatggtgcgcaagctggaacggcgggtgcagaccattctcgaataagcaatggcaagaaggctccgctcatgctatagctatagctagattatttatatatctagctatataaatagctcctattattagagtttttaagatattaatacctatacctaggctgaaagtataatatttaactttatcaagggtctaataaatccgggaaaaatcctaggatattctcagacaacctaacctatacccaggctaccctatagccagcttaccctagactaagtcttagatcttggataattccttcagctttaaagataaggtatctaatatctatactcaactgatttgtgattttccgcaaaattcatttgtatgggaaatcaaaaaaatcgactcacggccaccaaaccgcgcgaccgatatacatgaaaattccaaaaagtgacaaaccacgcccaataaagaccgcatgctgtaccaaatcacgcaaaagacattgctcgatcaaatggtcttgcacaccgtcccggcagagagtttgcccatcacaaccacgagccaagcacaaatctatctgcacatccagttcaacgtcagctatcccatgctgataggtcaactatcaacaaccttgcgaatgctggggtagcgccgaaagagatcaggtcctaggtgccagacaagttaccacagggataactggcttgtggcggccaagcgttcatagcgacgtcgctttttgatccttcgatgtcggctctcaaccacagcgcacccacaccaccacaaatccaaccacagcgaatgcacgccactgtaaattccaccacagcgtgcatgtcaaccacagcgcacccacaccaccacaaatccaaccacagcgaatgcacgccactgtaaattccaccacagcgtgcatccaccaccacaaatccaaccacagcacatgcacatcgccgggaaccaaacttcagcacatgcacctcactgggaatgccagatctcccgttgctcagtggtaagtttagccagcggccatccatccacagaacccatccagcgccggcgagagcagagctctagggaacccaataccctgttctttattgaagtgatcaccgatgtatactgacaaccattggatcccactagctaaaacagataatcatgatgatggcgtgacccgggccacgattttcaactgcggagatggttaggctgctgtagggtaaggtaccttgatcaccgcagccaactcttgacgactagcggaggcacggcatatacatagttgcggaagcggcactaactgagcccgcaagagtgggtcagtggctacagcccgctatgaccgctacggcctagcgggccctaggaaccctcaggggtccgggccaccagcatagctattattaggttatcgggcttatctagcccagataagggtctagaaaatccgggaaaaatcctaggatattctcagaggcaggcttgatacgctgatggattttgacgaggagcttacaactcggtatcttgtattgtaagtcttgtcccaacttgcttatattaagcctttactaaagctatagcttagagacctatagaagttaaaatggctacttctgggtctaagggaaaacaactcttagagggttcctataaggttccttctagtcctatatagattaaaaaccaatgcccttcggggctctctggtgattcatgataacttctcgaatcgcatggccttgcgccggcgatggttactagggcaaccacgacactctgggtcgggttgagagctaaggttccgggccgcttcctcttgcgatctcttgcagcctgtggagccgcaacaccaacaggggcaggtggagggtgctgacataatttgggcacccgggtgcgccaggatgtttgggcatccgggtgcccatgtatcagtcgccacaaacataccaggctcacgatttgggcttacctgtaccgggaacaagctccttgagttgaagatttggcgtcagcgctctgctgcggttatgagtacgacctggcgtgagaattattccttcccgcggattttcaagggacgtcgagagcgcaccagccccagcagaggtgctgggctcttccggccattaaaccctagctccggacaaaccgatttcagggtgatagaccgttaagaggttatgtaaagtgtaggttatgttgagtataggttatgtaaagtgtaggtgatgttgagtataggttatgtaaagtataggttaggtggcgtgtgttgtgtgtgaatatgctttggtggcattcccagtggattataccgttttcatcggggttctatcgccgtttatactgtcacattagtgtctgcctctccccttacgttcaatgtataataacaatttgaaagcaactcacccaaaagcaaacctcctgtagccggtttgcttctttgtagatcccatcgccgaaaccaaattcatttgtatgggaaatcaaaaaaatcgactcacggccaccaaaccgcgcgaccgatatacatgacttttgtaaaccgcgcccggcggactggccccttgagcgccgtcatgataagccggatacacctctactactggtgcaccttacatcatataccgacgccactatcctatcgactaatttgccgcatgcagtcgcagatcagatgggttacgcagagggattgcaacaccgggtttataagggaaattggcgggcattagcgtggaagttccttcttgagacctgccttgtgaacagctatcacttcggtccttcaagttctcattgaagtatttgctactaccaccaagatctgcactagaggccgttcaacccgggctcatctcgatccaagccaccctgattattggacacaagcccttcagtttacagaaaccatacaccgagatgtatatccgaccgtcgaccccacacaaccaagtctacaacgcatcgcaagctcagaggttgagcggaacgttgaagttgtttaggtcgtgagttcgaatcccaccttgggcataattatgttattctatatcatttcttataaaaatataattagccctctgatagtcatatttccgaacccagcgcgtacgaagctctggttgccgcttgataaagttggaagcccaattgactccaacagggggcgcgccgcgtacgttggtagaagaggcatgcgagagatatgggaggcggctgcaaaggatgacagagagcagcagagcttatattcaactaagtagtctttctggatttatggccgttctagatcttagaaaaaaccagaagttggacgtaaatccagccccgcttcattgaataagtaaaaaaacaataggagtagtggtatttcaccgtcgccgaagctcccacctattctacacctcctatgtcttttcacaatgtcaaactagagtcaagctcaacagggtcttcttagaagagaattaaatagaatagaattattagaaagtttattagatagaaaaattaaattaaataaaattaatttaataatattttcgaaaattccaaaaagtgacaaaccacgcccaataaagaccgcatgctgtaccaaatcacgcaaaagacattgctcgagccaatgcatcctctcattatcctctcaccccaccgagccaatcttcttcgggcggatcggttgtgcgaccatcaatgtctcctcgatcgaagagacccctggtttaagtaccaagtctttactccgatggatgatcgatcagccagatcttcattggttatgagtacgacctggcgtgagaattattccttcccgcggattttcaagggacgtcgagagcgcaccagacccagccgaggtgctgggctcttccggccattaaaccctagctccggacaaaccgatttcagggtgatagaccgttaagaagaaaagatagttacctggttgattctgccagtagtcatatgcttgtctcaaagattaagacatgcatgtctaagtataagcaattatacggcgaaactgcgaatggctcattatataagttatcgtttatttgatagtattcctgattaatgaaaacatccttggcaaatgctttcgcagtagttagtcttcaataaatccaagaatttcacctctgacaattagggcttaagttcgggggtagaggcggaacaacctttcgtctcttcgttcgttcctctcttcgttcctcaaggcacaggggaatgcgcactcgtcaaccggtataacaaagcgatggcggtcggtctccgccacaaccacgatatatcgatgatcttgacgaggaccaagggcctggccatggtgttttacatcaccaagaaggggagaaaaggtatataacctccccttctgccattgattcaggcttttaattttctaccatcaatcatcaaatattctaaatcatcaatttacttaacccccgttccatccgggtcatgctgttcaacgtaggtgaaagctgcctcggctagccactgtttgaacggcttattgactgctgtatcgagaggttgaagatccctaagcttttatacgtccgcctataagttcgggcgtagatctatgctttcttgagtagggcggacgaattcggtagcgaagtgtcgggtttcctgccattcgattgttcattcacgaatgttttcagtcacctggcgagtgcttgctagcatagcttgcgctagcgctacacaaaaataaatataaataaatatgaagaatattattcctattaaattatatttagatgttacaattaaataaaagattattttagtacttattttatagtagtattaaaaaaaaataaaaataaggagtacccaggctcatgggagggcgtcccgcgggcgctgcagggtatgtaaaatcaaaaaagttgttaagagccgcggtaaagtacccaggctcatgggagggcgtcccgcgggcgctgcagggtatgtaaaatcaaaaaagttgttaagagccgcggtaagttattgttttaggtattcctacctgatctgaggtcaaccttggaaagttgggggtttaacggcaggggctcgtcgctctccgatgcggaagatcactacttcgcagaggaggccacgacgggtccgccactagatttaggggccggccgtccctcgcgggctttggccgagctcgcgaagctgattattctgaccaccacttcaaaaaaagtcatgtatatcggtcgcgcggtttggtggccgtgagtcgattgggtgaacaatccaacgcttaccgaattctgcttcggtatgataggaagagccgacatcgaaggatcaaaaagcgacgttaacggcaggggctcgtcgctctccgatgcggaatatcactacttcgcagaggaggccacgacgggtccgccactagattttgtttcaagacgggtcgttgatgaccattacgccagcatccttgcagagcgcgaacctcagtccaccccagggtattacacactctattggggaaatcgaggcgaaggacggcttaccctcagcagatcgtaacaacaaggctactctactgcttacaggaccgctgctgaagtagcttttgggcttgcacattcggtctttgatatgtccttttcttgcggtttcacgactgtggcaccaacattgctgcgacgtcttttgatagcctttgactgtcgatcaatcattgtccccttgttataatttcacaattgtaacgccatcggtgtttgtaacgaccacagcgtgcatgcaccaccacaaatccaaccacagcacatgcacatcgccgggaaccaaacttcagcacatgcaccccactgggaatgccaccaaagcatattcacacacaacacacgccacctaacctatactttacataacctatactcaacataccacagcgtgcatgcaccaccacaaatccaaccacagcacatgcacatcgccgggaaccaaacttcagcacatgcaccgcactgggaatgccaccaaagcatattcacacacaacacacgccacctaacctatactttacataacctatactcaacattcatcgtgtttgtcacctggttggtggcagtctcggggtccggtacattgtggctgggatagagggatgtctagtcgatccgcgcattgctacatgtactcgagccgccgattcattactataggaaatctaaaaaatcaactcacaaccaccaaaaccttcgaccgatatatatagcttttataagacacacttttatcttttcaaccctcatgcccctagggcgtggtgttggggatcggccaaagcccgcgagggacggccggcccctaaatctagtggcggatccaaccacagcgaatgcacgccactgtaaattccaccacagcgtgcatgcaccaccacaaatccaaccacagcacatacacatcgccgatccaaccacagcgaatgcacgccactgtaaattccaccacagcgtgcatgcaccaccacaaatccaaccacagcacatccacatcgccgggaaccaaacttcagttcccgggccagttttgattttccgcaaaattcatttgtatgggaaatcaaaaaaatcgactcacggccaccaaaccgcccgaccgatatacatgacttttgtaaacccgccatcccatctcttctaagctaccctgaaggctatatcgcctaagataccacccatctaaccaagtcaaaggacaagttagttgcaatttccgcacttgccaaagaagcgcgtcaagccctgaaagatgactatcttgctgggctttggaggcggcatctcgggtgggaactgggatggcggttgtgagttgattttttagatttcccatagtaatgaattttgcggaaaatcaaaagtggcccgggaagcagctttagtaggttttagagtagtttttagtcggtagatctatgagagaaattagatagaattttctggtctctctcacaaaaataagattcttttgcgctatattttgcactatattcgcaccatgttcgtgcctgtggatattactgattgggacgatgtagccgctctgtttacttccaccatcagtaaatttgggcgtgtggacattgtcattgctaatgcgggtatcatggaaagtcataaatttttcgacttccaaacgaacgaggcaggattccggcccctggatgtgggttttgcgcggcaacgcaactgaacgcggagacgacggcgggggccccaggcagagttctcttttcttatgcaattgcgacagggaagcgatccgtcacactaaccggaaaagtatcagctggccgcgcacgacataagcgtcatatgaaaaaaaagggggataggggacccaagaccttctgcttccgagtatgacactgtgagcaagctttggcaatccggccaccagaggctaggcatccaaccgtacggggctctcaccctctatggcgtcccgttccagggaactcggaaggcacgtcgcccgcctctgggcggatgaggtgatcaagagggcagcaggcgacgcagatggaagcacactgacagcagcaccggagcccgaggcagtgtggtcagcagattacatgcggcggattctgcagcggcacagcgaacgatgtataggggccaagctgactattaggtggccaccgaccacaatcaacaacgaataacatacagctaacctcttgagttattgcttaaccaatcttatccgagaatgtcatggcattcttgttaggccatcgcctaaatgctgagtctatgtgggcttcttccgttacatgataccattttgagtttccacacccaaatttcatcttcaatttcgttcctcaaggctccttctgggcaacccgcttgcgggttgcgtctcctgtacaaccagcgctgcccacaaatcaaatgcaatcaaacaaacagccaaacaaatcaatcaaatatgccagaatcttatctccacacgagcacaagcgcacgaacaccaacaacgcctctcgaaggcggaagaagagagagtcaggagatggatcgtatctcaagaattgctaggatacgcacctacgcatcgacagcttcgatatatcgcttcccagatccttcaaggtgatcttattttatttactgtgaatacttgttcacataaaaaattatattttatttatgtatatacgagatacaaataatattacaattcttggtaatatatatttagataaaatatataatattaatacgattaaaccaaaagaaaatacgatttcattctgagcactcctcttggggcgcccaagccgcaccggccctagtggtcttggtgtggtggaaggatgccctggggaactgggagggggaaggtggattgccgtgcgcggcgtcggtggccctgccgctggtgctgtgttcggcgcgctctcacgagtgccctgagcactcctcttggggcgcccaagccgcaccggccctagtggtcttggtgtggtggaaggatgccctggggaactgcgagggggaaggtggattgccgtgcgcggcgtcggtggccctgccgctggtgctgtgttcggcgcgctctcacgagtgccgggcatcgtttctaccctgagggcgaggtatgggtgagacgcttgagcgccatccattttcagggctagtacattcggttggatggactaggtcttcattgcgggggtatggaatgacgcggacgacttcggcagcctcagcgggggccagtgggtggggcgggccgtagtaaatattgccctgaatatcgccctggttgatgaagttgttgccacgaaattggttatcactgacgtcgcgccggtgatgatccgacgatcgacccttcactactatctaccatgtctccgtccgataaataccttggtcaatcttttctcgacgaagaacagctgcgagccatgatgtcttccagtgagcgaaaggggagcagcacagagaccgttcgtgaagaatcgctcttgtatgggaaatcaaaaaaatcgactcacggccaccaaaccgcgcgaccgatatacatgacttttgtaaacccgccatccctcacctcacattaaccgctttgcgaagagactccgcggctggcctctcgcgatccctcattaaggaagaggttggatcacccggcctagcaagttcgtctgtagctattacgtgggatatcgcccttttggtacgtgataatattgatcgcgagacgttcttttggatcttgtaattggaatgagtacaatttaaatcccttaacgaggaacaattggagggcaagtctggtgccatccttttagtagcgtgaaaattcacccaccaaatttcaacggatcctactaggaaccgtcgtggcattaatgatagggtccttgaagtataatctcttgttattaagctatttaggttatctaggcagctgcgatccagctgatatacagctattttaattataaatactctataaatatattaataatatattagtaaaaagctatatataattattaactttatttataaattatcttataatatttatactaaagaaaaatagaaaattataacttattataaactactaatagcttaataagattatatataaagatagaatatttttactattaattatagaacttagagattaattatagagaaaatagtagtttattatactagatcttaaaagagcttataatctaatataaattaaaaaagaaaataaatagaaaataatatttagaataaagtttaatttttataagtactttataataccctttaaactaataaatatatctataatattctaataaataattaattaaatactttagaagtattttaatatctttatagttatttatcttaataatattttaattttcttagataatctaaagatatataaaaaatatatatataagattttagaaaaactaaaagatataaaacttctagtagaactagagaaaagttatttctatatataaaaagttaacttcttagaatatactatttaactaaataaaatataaatagaataagataaaattactataattaaagaataggaaatattaaaaactattaagaaaatataagctttctttagatttactaattactactaataatttattaagaattataggaaaattactatatctctatataatattattaaaaaagaaatagagttctaatagaataataaatagtaagaaatatttaataaaattaagaattaaatacttttagaacttatactatagatatttaattctataaaggaaatagaatttaaaactaatactttagattttataattagtatataatttagctaaagggataataataaagtactataccctatagtattcttcttaaagaaactatatagtataaaacttaattattctatctataataaagaatttatagttattatatatatatttaaagagtttaaatactactacttagaaataatatataaggttaagatatatatagattataaaaatatctaatattttactataatctagtaatttaataaaagataaatctactatactaaatatttattctaatttaattataaaataatatattaaaaagaattagaaaatagaagagctaatacccttaaatataaattaaaatataaataaactatatttaaaataaataaataattatttattataaataataaaaaatacttagtataaaaagccttaggagtaatatttaaggaaatattatatattaaatatatatataggaaggtaatatattagatatagaatatattactattagtattatatagatatacttaatatatagaatattaagtatatataggttaggtggcgtgtgttgtgtgtgaatatgctttggtggcattcccagtgaggtgcatgtgctgaagtttggttccataggttaggtggcgtgtgttgtgtgtgaatatgctttggtggcattcccagtgaggtgcatgtgctgaagtttggttcgcggcgatgtgcatgtgctgtggttggatttgtggtggtgcatgcacgctgtggtggaatttacagtggcgtgcattcgcacccctgggaggccgtacccggatccgggagaagtgttcgatagttcgtgctcaagcagcaaatcaatgaatcttcgcccgagctaacgcttgacagaactgctggctcgtcagggaccaccaaaagaacacccaaacaagatctcgaccatgctcttctatatggctactattatcatccacggttagcttcctttccattagaggttcgtggcttccgtacgcgctgcctcttcctcctcaattcgtcaagcccaccttgtacgtcttttatctgtgcaagtgagcagaaaatctcattcttatctggttcaacggctctacgcttcttatgacttaggcgttcattcagggcctgccgctggctaaacttaccactgagcaacgggagatcgccacgtgcagcggacaccgccatggttgaagctgtgcgctgcgcggcgcgagtgctgaaggcgaaagcctaaggcgctgcagcaaaccactcacagcgtctcgggtcaactgtaacaagctgggccgatccgctgtgggaaatctcttcaactgtaccgtatcttgcagattcccactgagtggtcacttggacaggctagacaagggatgccaaaatcggactctctgactacctcgaccgctggtaccgctgcaacgggccggtggatgagcagcaaaaggcaattgtaagggatgccaaaatcggactctctgactacctcgaccgctggtaccgctgcaacgggccggtggatgagcagcaaaagacaattgtggagactgcggcacccccaagcgtaccaccgaaaatatcaaaaggtagtgtgtttaagcagtgggtcaaaagttgctgttcttgcatctgctcgttgtctcctgaacttcagaaccttctctctcgcgacctcgatgtcctcatggagttgtagcagatgtcgagtcctagcctcgagcaggctctgagtggaccgcacgtcttcttgaaacacggaccaaggagtcgtcttcgtatgcgagtgttcgggtgtcaaacccctacgcgtaatgaaagtgaacgtaggagtatataacaataactgttatataatatatacataatagaataaactactttttataaacatatactaaaaaataaataaatttaagatatataattgttatttatataaatacaagtataaaaagggattattatggaattttagctgtatattaaagagccacttttgattttccgcaaaattcatttgtatgggaaatcaaaaaaatcgactcacggccaccaaaccgcgcgaccgctatacatgactttttttgaagtggtggtcagaatatcacgctccccatcaccacgcgtgaagcatcaatccctgagtccgagccgcgcgtcgtccccgaggaacgacgcctcaacatcagctggaaatccggacttctcctcatcggcctcttcctcatcacttttatcacttcctgattcacttgttaaaactgcaagaaatcctgaccgacgtggtggcacactacaacgacgacgagtctgccacagcagacgaaagtggcgacgcgttaccacattacagatatggtgtagaaccgttcttccgaccttgccgagatgggcggcggcaaggactctcgcgcctcttgcaaaggctagcaattgccataactaacttcatacgcagctgatggagcccttctctactctggaccttagccacctgtgagaacagacttgctactagtgttatatatattagtaatagttagattaattcttatactaaactattatatataatttatactattagtaatagttatatttaattattttatttatagttaatatatacttataagtattattctagagtttaatttaaatattctatttaattattactttatagatctaacccacgtccaaccgctgttcacatggaacctttccccacttcggtccttcaagttctcattgaagtatttgctactgcgtgtggacattgtcattgctaatgcgggtatcatggaaagtcataaatttttcgacttccaaacgaacgaggcaggatgcttgatggacgatggatcaagccgggtcatcgatgtgaatctcaagggaacaatgaacagtgcgttccacaagccattttatacctgaatccctagtaagcgcaagtcatcagcttgcgttgattacgtccctgccctttgtacacaccgcccgtcgctactacctattgttgtccggagctagggtttaatggccggaagagcccagcacctctgctgggtctggtgcgctctcgacgtcccttgaaaagatcgaaagatgaaaagcactttgaaaagagggttaaaaagtacgtgaaattgttgaaagggaagcgttcatgaccagacacggtcctgtaagcagtagagtagccttgttgttacgatctgctgagggtaagccgtccttcgcctcgatttccccaatagcggagacgacggcgggggccccaggcagagttctcttttcttcttaacggtctatcaccctgaaatcggtttgtccggggctagggtttaatggccggaagagcccagcacctctgctgggtctggtgcgctctcgacgtcccttgaaaatccgcgggcctcattgtgtctggacctggtgagtttccccgtgttgagtcaaattaagccgcaggctccacccctggtggtgcccttccgtcgataaatttatccttttgtagcgctgcgttatagttaacaaagttaaagctatgtataacttaaggaacactagaatgtataatatatatatagaaattaaaacaaaatagttgaatatttaaaataaatagttcgagctacgaggttattgaaaaaaaatcctgactgcttcaggagggtgtattgcttccttgacgatcctagcaccagcccgttgcctctgactccctccataataccggcttcatccatattccaacggtctcttggagagatgcgtttgatagctggatggttcattattgcgaagaaatcctatgcgattcaggtccaagctacaggagggcagccgttcatcttggtagaacgaggcgcggactttgcagacagcctgcaggaagacttcttcccccgcaccttcccgagccttttcccctgggggagaggtggcccaaaggcggtgcatacatctggccaagctagaggtgccagaaaagttaccacagggataactggcttgtggcggccaagcgttcatagcgacgtcgctttttgctccttcgatgtcggctcttcctatcataccgaagcagaattcggtaagcgttggattgttcacccactaatagggaacgatgaaagtgtggcctatcgatcctttagtccttcgacgtgtgaagctagaggtgccagaaaagttaccacagggataactggcttgtggcggatgaaagtgtggcctatcgatcctttagtccttcgacgtgtgaagctagaggtgccagaaaagttaccacagggataacgacatctccttctacagtatcttaggcgatatagccttcagggtagcttagaagagatgggatggcgggtttacaaaagtcatgtatatcggtcagcttcaaccatggcggtgtccgctgcacgtggcgatctcccgttgctcagtggtaagtttagccagcggccatccatcccatttggcaaggatgttttcattaatcaggaacgaaagttaggggatcgaagacgatcagataccgtcgtagtcttaaccataaacggattgccgtgcgcggcgtcggtggccctgccgctggtgctgtgttcggcgcgctctcacgagtgccattcagtaactaatcgcgccggattggcatagtcctcatccgtggcgtcgccgtaaagtcgttccaacatactcgcaagaggcacggctcctctttatccttcaggaagcgagtcaggattgcaacattctcttttccggatgccatagttactcccgccgtttacccgcgcttggtcgaatggcttcgctttgacattcagagcactgggcagaaatcacattgcgtcaaactctgatatactaatactaaacctaacctaataagactaataccctgatctgaatataactaaaaataatataaagcttaaataattaatttttaagagctacctctactcctcttccttcaagccgtgtgttcaataggatcagaacgctcttcgaggcatcggctccgcgccgatctctcggtattggattgatcgtcaggtcagtggtgtcgcttctatgcctttggcatgccaacaaggcagttctacgttactgtcagccaagttttatgcgccataacaatatacacaataatcctttattactacccaacatttttataatctattaatatactaataaataaaagaaataaaaaaaaaaagaatgaatgaaaaataatgaagaactctaacacagttatgctgacgaagtcaaggaatcgtttactaaagagatttctgttctccatgagccccccttaggacacctgcgttatggtttaacagatgtgccgccccagccaaactcccccatagcacacccagacactctcaccatgatcatgcaagcacccggccagttacagggcacctaccctactaaaacaaccccgcacattgcgcccgccagtattctggcgggcatgcctgtctgagcgtcatttcaaccctcatgcccctagggcgtggtgacgtgagtggagcctatccacaatgggcgcctagatctaaataggtaataggggaaaatgtcctttgggtgtattattctgagagtagcatgtggtccgaagtgcttctgcctgcggcgctgcactgcgccttaatgtcaattgaagtcctaagaaatttaatccattcatgcgcgtcactaattagatgacgaggcatttggctaccttaagagagtcatagttactcccgccgtttaccgtactatcaaataaacgataacttatataatgagccattcgcagtttcgccgtataattgcttatacttagacatgcatggtactatcaaataaacgataacttatataatgagccattcgcagtttcgccgtataattgcttatacttagacatgcatctgctggcaccagacttgccctccaattgttcctcgttaagggatttaaattgtactcattccaattacaagatccaaaagagggtcggtgcgcctatgagagaggggcgcgagtgctgaaggcgaaagcctaaggcgctgcagcaaaccactcacagcgtctcgggtcaacatgaattttgcggaaaatcaaaactggcccgggaactgaccgtggcgtgcaagagggtaaatgtgggccggtgtatttcggaagagtacccaggctcatgggagggcgtcccgcgggcgctgcagggtatgtaaaatcaaaaaagactcccttggccgaaaggcctgggtaatcttgttaaactccgtcgtgctggggatagagcattgcaattattgctcttccacgaggaatctcggcgcttgcttagtacctcatttgccgtacgaagatcccggacctcagcacgtaaaagagccacctggtgcatcattgcagttgccccctttgtaaattgatccattgcagccagcatagaggttggagacatgggcattacaacacctcaaatcgctctatcagcgtgatctcccgtctgtcattttgacggaccggtgcctagccgcaatgaatgctgctgctacatggttctcttcatcgaaagcactgctttgcctgtgctaacaccctgctgctgctgctgccggaatagcactcgtgtgcttattatccccccttcctctccatcatctcgccctacccctgttgcctgcctagccctggcacatacatcacacgctgcctcacctgcctcgcatggccctggccctgacccatcccgaaggcacagagcgaagtcaacaggcagtaggcgccagggttctgctccatgtaaagcacctgctgttccacagagttacggtcgaggatcggtagctgggggtataggttgtcgaaactatcaaataaacgataacttatataatgagccattcgcagtttcgccgtataattgcttatacttagacatgcatggccgcacatctccttctccagtatcttaggcgatatagccttcagggtagcttagaagagatgggatggcgggtttacaaaagttcgccacgtgcagcggacaccgccatggttgaagctgtgcgctgagcactcctcttggggcgcccaagccgcaccggccctctatttagcttcttctttttttctctattttatacttattttattaatatatcttattataaatacttactcccttaagctatatacccgtccaactgtctggatgtactaacaccttttgtggtgtctgatgagcgtctactctggcaccttaacctcgcgttcgtttcatcccgcatcgccagttctgcttaccaaaaatggcccactagtattgatacattcgaatgctcacgttcaattaagccggtctcccgccttccacgcggatcggagggaagtgagaaggccagtatttcaaagagctcgcgaagctgattattctgacctgaggttcgcgctctgcaaggatgctggcgtaatggtcatcaacgacccgtcttgaaacacggaccaaggagtcgtcttgtcagctgcattagcggtcctcgtgtccgctgtagcgcttgcattagcggacctcgtgtccgctgtacgagaaccttagcacttacaataacctggctatgtgatagagcattgccgagagcatcttgaatttgcacccatccagctaattcggtctcctgcttccttaagaggcgttacttaaagaaattgacggaagggcaccaccaggggtggagcctgcggcttaatttgactcaacacggggaaactcaccaggtaggaaaggtagttattactattagataataagcttcccctcttaggggctatagctatagccgggttatttatatatctggctgtataaatagctcctattattagagtttttaaggtatgctttccggccctgagtggtggtttccctcctctctgggccagtccggacgcctcactgagccattcaatcggtagtagcgccaaagcccaacgtacccaacccttagagccaatccttatcccgaagttacggatctattttgccgacttcccttatctccattgttctatcaaccagaggctgttcaccttggagacctgctgcggttatgagtacgacctggcgtgagaattattccgggaatagataatataaacatgagaaacctttatttttttttcatacgaatgagagggtttaagactttgaaagcattgtcttttaatgttttaaatacaactagtctctgcctattttatatatatatctttatatataaataggtacccttagataaaaagcgaagccattcgaccaagcgcgggtaaacggcgggagtaactatgactctcttaaggtagccaaatgcctcgtcagctaattagtgacgcgcatgaatggattaacgagattcccactgtccctatctactatctagcgaaaccacagccaaggggaagtgggtggaataagaggcaggcaaccttgatcctttatatcttcgcagatgggatccaacggttgaaaccgaaggtcattttccacggcaagcccgagggtcagatctttgaaaacgtgagaggaaggctcggcgatgtggcgtgtgcggaaagtccggtcataatgcgcgaacttgtcagattaatgtggagatacctaatgaagagaatagcatttaaaactgatcgatttcctttattgtggttgcttttttgcaacctctttgcgagaaggtcatggaataataaaataggacgtgtggttctattttgttggtttctaggaccgccgtaatgattaatagggacagtcggtggcatcagttttatctaaaagagactcttaagctgatcagttgagtatagatattgaatatcttatctttaaagctgaaggaactattcaagatctaagacctagcggagttagcagttgagagctataagttatagcgaacttccctgctgcgttatagcggtctcaaggcctaatacaccttgaaggccactgtaatttcaacaaccctaaatcttatccaaaaatatcaggagatatagtattcaatagctctgaatctacttaattcggtgtgcaaatttcgtgctcatatcatttgaagcggtggtacaagagccggttgaaaatatagcaaaattgcagtaatgtgcagcttcatcgcgcggctgcgttgcgcagcatcaaaacgatatattccttcttttcttaccttcgcattcatcgcacgtattacagccgcttgatatatcagttttttcaccggtcaactctggccggtatttagctttagaagacgtatacctcccatttagagcagcattcccaaactactcgactcgtcgaaggcgtttcacagaggctaggcatccaaccgtacggggctctcaccctctatggcgtcccgttccagggaactcggaaggcacgcgatggttcattcaaatttcttccctatcaactttcgatgtttgggtattggccaaacatggttgcaacgggtaacggggggttagggctcgaccccggagaaggagcctgagaaacggctactacatccaaggaaggcagcaggcgcgcaaattacctaatggtcatcaacgacccgtcttgaaacacggaccaaggagtcgtcttcgtatgcgagtgttcgggtgtcaaacccctccgcgtaatgaaagtgaacgtaggagagagcttcggcgcatctccgaccgatcctgatgttctcggatggatttgagtaattgcgaagaaggatattctaattgattcatcgccaatcagcaagatgaccttccttcagtgttatgcaaaggctcgattgatcggtctaacagatacgaatattcgcgattcgcttcctctctgttgtctttgtgtctataattaagaggagggagtaccttaaagctaccttagtgtactttgccactgatttgcagtatgttgaaatatccattaatggccgatacttaagtacctcgaagtagactaagtaccgacctaggaggcttcggcgcatctccgaccgatcctgatgttctcggatggatttgagtaagagcatacggggccggacccgaaagaaggaaccgtacggggctctcaccctctatggcgtcccgttccagggaactcggaaggcacgtcgccagaaacatcctctacacattacaactcgggcttgcgccagatttcaaatttgagctgttgccgcttcactcgccgttactagggcaatccctgttgttgccaaatgacgctttgccaaatgacgctttgccaaatgacgctttgccaaatgacgctttgccaaatgacgctttgccaaatgacatcgtccgatccctagtcggcatagtttatggttaagactacgacggtatctgatcgtcttcgatcccctaactttcgttcctggctgcagggtagccagtctatctttacatcccgcacatctccttctccagtatcttaggcgatatagccttcagggtattcgagaggttatttcgtagcttaaagttagtccaccatccattagaaaatgtaaaaatagctgcacaattggggtattttaacgggaaaagcttgtatgctttcctcttgaaccagctaacagtaagtagcctacctagcttcctagcctggtggaattccttcatgagagcttctttctaagttttagtaattatttatagtataaatagatataaaatataagcttttaatagcttactatctataaagtaatagttaaatagcaccaaccaggtgacaaacacgatgacgaaagacaggtgaggagagtcacagttctctgcctcaagaggcagtgtacacagagagctgcatgaagtcggttgtgatgtgcgcctttgaaacggaacttccctatggcttaggatcgactaacccacgtccaaccgctgttcacatggaacctttcgccacttcgaaagagggttaaaaagtacgtgaaattgttgaaagggaagcgttcatgaccagacttgggcaggttgatcatccgtggtgctccgcggtgcactctgcctgcccaggccagcatcagttcgccccgggggataaaggctttgggaatgtggctccctcgtgcctcatttgccttccgaagagtagcaacctcctcacgtaggattgccacctcatgcataacacgctgtgtaccctttgcaatcttattgattcatgcattggatcgagcaatgtcttttgcgtgatttggtacagcatgcggtctttattgggcgtggtttgtcactttttggaatgcattggatcgagcaatgtcttttgcgtgatttggtacagcatgcggtctttattgggcgtggtttgtcactttttgtaattttcgaccagaaaatggaaaggtactacataccgcctgtagctcacgctcagtagaccggccctccctgtatctagccactgtcctcgacttacagcgcttcccaccctctaaccgcctgtagctcacgctcagtagaccggccctccctgtatctagccactgtcctcgacttacagcgcttcccaccctccaaaacaataaagcctgctaagggcatcagcacccaggtgctggctgccgccggccggttgcccggctagtggctgcctgctcccgaggcgagcctgctaagggcatcagcacccaggtgctggctgccgccggccggttgcccggctagtggctgcctgctcccgaggcctcctcccaaagcccaacgtacccaacccttagagccaatccttatcccgaagttacggatctattttgccgacttccctagcctgctaagggcatcagcacccaggtgctggctgccgccggccggttgcccggctagtggctgcctgctcccgaggctccttggtgcagctaagggagcagtatgtaccttacaggggtatgattggctggacagagcaaataatccctgacataacgggtacttatttttacgcctaaattagcctatgatagaagtcccagcaatattgcgagctacaaatagctacattacatgggcaagtgcacgctttttgacgggaggctatcccgtcgggcaccaacgaccatgtacacagtcttaaacattcaatcaatggtggctgtcatcgcaactagctaggaagtagttagtgtctcacaaatacagacatgcatgttaggggccagcgctgtttcaaccttggaaagttgggcgtttaacggcaggggctcgtcgctctccgatgcggaatatcactacttcgcagaggaggccacgacgggtccgccactacgacctgatgaacttgacaacattgtggagttttcccaccggctctttctttctccaatgacgtaggtcatcctcgtatcggccgagaaggtcaaagacctgcgattcggcctcgaaagcctcatggtttgtattcacactgaaaatcaaaatcaaggggacttttacccttttgttctactggagatttctgttctccatgcgccccccttaggacacctgcgttatggtttaacagatgtgccgccccagccaaactccccacctgacaatgtcttcaacgcagaatcaaccaggtaactatcgttcgccggggttggccaccagcgcccacgaggggcactggagaattagttactgagtggcactcgtgagagcgcgccgaacacagcacatctgaggtcaaccttggaaagttgggggtttaacggcaggggctcgtcgctctccgatgcggaatatcactacttcgcaagcaattatacggcgaaactgcgaatggctcattatataagttatcgtttatttgatagtaccttactacttggataacagtggtaattctaagcaattatacggcgaaactgcgaatggctcattatataagttatcgtttatttgatagtaccttactacttggataactgtggtaattctagagctaatctaagatactggagaaggagatgtgcgggatgtaaagatagactggctaccctgcagccgcttcccgagagacagaccgcgcgccagaactctgcatctcttctaagctaccctgaaggctatatcgcctaagatactggagaaggagatgtgcgggatgtaaagatagactgtctaccctgcagccgcttccaccacgccctaggggcatgagggttgaaatgacgctcagacaggcatgcccgccagaatactggcgggcgcaatgtgcggtcaaagattcgatgattcactgaattctgcaattcacattacttatcgcatttcgctgcgttcttcatcgatgccagaaactggggcgaattgataaaaatcccccatcaaaagaacgacgggaataccgccaaagggctgatcaggacagtctctgagcgactggaggcggcagctggcctcatacagggtagcgcctccaagcatgctaacctcgtcgatcacgataagccttccttagatttactaactactattaataatttattaaggattatagaaaaattactatacccttatataatactataaaaaaggaaatagaattttaataggaagataaatagtaaaaagtatttaataaaattggctgtcgctgtacaaagcgagaggcccaattgatgccaacgcgctccgcgtcgcggtcgcgtagcagtaagttcgccatatctgccatccaggtgccggaatattgaccggcttccctttcgccacacggcgcaaagtgcgcctttgaaacggaacttccctatggatccaggtgccggaatattgaccggcttccctttcgccacacggcgcaaagtgcgcctttgaaacggaacttccctatgtcttaggatcgactaacccacgtccaaccgctgttcacatggaacctttccccacttcggtccttcaagttctcattgaaatccaggtgccggaatattgaccggcttccctttcgccacacggcgcaaagtgcgcctttgaaacggaacttccctatgccttaggatcgactaacccacgtccaaccgctgttcacatggaacctttccccacttcggtccttcaagttctcattgaagaggtcgggctgttcagataacctcttacaagcagctgcaactgtatgcgttgtcatgacgcgtttgtcttgaacagactacttcttcgttccatccgggtcatgctgttcaacgtaggtgaaagctgcctcggctagccactgtttgaacggcttattttcaaaaaaagtcatgtatatcggtcgcgcggtttggtggccgtgagtcgatttttttgatttcccatacaaatgaatttacccctacgcgtaatgaaagtgaacgtaggagagagcttcggcgcatctccgaccgatcctgatgttctcggatggattggagtaagagcatacggggccggacccgaaagataccccacccctgcgttctcatggtctgcagatggaacggctcaaggatatgcttgatttctgccaagagcctccagtcatccccatggctgaacgcctctaagtcagaatccatgccagaaagcggtgataccacccgcacgtacagatggacaagaataggcgtcggcttagcgtcttagcaggcgattactctacggtactagaagtgtgctgtagtatttcgcgtattgtaattttaaaaggtgagttgttacacagtccttagcggattccgacttccatggccagcgtccaactgtctggatgtactaacaccttttgtggtgtctgatgagcgtctactctggcaccttaacctcgcgttcggatattttatttagctgaatagtatatcctaagaagttaacttcttatatatagaaatagcttttctctagttctactaatagttttatatcttctgggttggccaccagcgcccacgaggggcactggagaattagttactgaatggcactcgtgagagcgcgccgaacacagccccagcggcagggccaccgacgccgcgcacggcaatccaccttccccctctcagttccccagggcatccttccaccacactccaattgagaacctatgggctcttatgaaggctgagatctatctactttatccagagcttgagtttgctccagataatgttgatacacttaaccggctagtagcagccgcaaaggaagcttggcatgctattgaagatcatatacaccaaagcctgattaagggcttgtgtccaataatcagggtggcttggatcgagaggcatgactgatattgttttaattgagagctaagttgggcgtggttggcttcgctgaggatgggggagacgaggagatatggagcttacaactcggtatcttgtattgtaagtcttgtcccaacttgcttggaatatatctccaacctggttctataggacatgtaatgttattcatgctgtacggagccgcatgcaagaagctgggatgtggctcaacaaactagaaaagaggctcaaagtggctgaagctccatggggcttagaaaagctcagctcgccgagcactacacccccatcttttatttttaagagtcacccgaccgggacaagcatgaggagttcgtctgccgctaccgcgccgaacttgctggcggggagccggcggaggcttccatggcggtgtccgctgcacgtggcgatctcccgttgctcagtggtaagtttagccagcggccatccatccacagaacccataatttaccgcggctcttaacaacttttttgattttacataccctgcagcgcccgcgggacgccctcccatgagcctggttaatttaccgcggctcttaacaacttttttgattttacataccctgcagcgcccgcgggacgccctcccatgagcctggggactcttcagaaatacaccggcccacatttaccctcttgcacgccacggtcagttcccgggccagttttgattttccgcaaatttaccgcggctcttaacaacttttttgattttacataccctgcagcgcccgcgggacgccctcccatgagcctgggcactcttcagaaatacaccggcccacatttacccacatcacccagccgcattattatcctaaaaatcgcagtccgctcttcgcagctgtgtatacgaagaactcggagatactttcgatgctgctgaggaatgcaatgggctttcctcaacgctacgataaagcaagttataattggtgtttggactataagcagatgggtaaacgatgcagagcaacagaacctagccgggagtggactaaggaggagatgatagcatacctagactggaataaggcagaagataaacgttatatctctaattattatattatttaatctagctattatatatatatattacttaattttctatatacttctaattatactatagtttaagttttttatctttataaaccttatactatagttctttatatatttctactagtagttctttatatatatatttaatagggttttattgggcgtggtttgtcactttttggaattttcgaccagaaaatggaaaggtactacatagcacacccagacactctcaccatgatcatctggaagtagaagtggcaaagccggcaaaccgatttgctggttgcgatgaacatattcccatcccaaaaatccgatggcctgatctttctcaccgtggtaagatagtcgtgcatatggacctctgcatgaataaaagtcttggtcttcctgtcgaagatctgtattaaattaattttatttaatttaacttttctatctaataaactttctaataattctattctatttaattctcttctatttaataatactctcctacgttcactttcattacgcgtaggggtttgacacccgaacactcgcatacgaagacgactccttggtccgtgttgctaacttctcgaatcgcatggccttgcgccggcgatggttcattcaaatttcttccctatcaactttcgatgtttgggtattggcccaattgttcctcgttaagggatttaaattgtactcattccaattacaagatccaaaagaaccctgtatcagtatttattgcaattgttcctcgttaagggatttaaattgtactcattccaattacaagatccaaaagaaccctgtatcagtatttattttcactacctccccgagtcgggattgggtaatttgcgcgcctgctgccttccttggatgtagtagccgtttctcaggctcttcaaagattcgatgattcactgaattctgcaattcacattacttatcgcatttcgctgcgttcttcatcgatgccagaattcgctccgatccgcgtggaaggcgggagaccggtttgaagttggggtaccgggtaggcagaaaccacaaccagctaccctataggcagaaaccacaaccagctaccctatacccggcgaactcaaaccaaatctgccgccgccacgcagcctcgggcagggagagaggataatgagaggatgcattggatcgagcaatgtcttttgcgtgatttggtacagcatgcggtctaagcaattatacggcgaaactgcgaatggctcattatataagttatcgtttatttgatagtaccttactacttggataaacgtggtaattctagagctaatacatgcttaaaatcccgacttcggaagggatgtatttattatagaccacctcatgatgttgatcagctgtcgaagtgcccgatttgttccggatcaggcaagtactctctcatgggattgttacttcggctggctggggtatgtcagttggtatggagggcgaaatgcctggtgttgcctggcttcagggatttcagggaagcttcgcgagctctttgaaatactggccttctcacttccctccgatccgcgtggaaggcgggagaccggtttgaagtttgggtaccgggtaggcagaaaccacaaccagctaccctatacccggcgaactcaaaccaaatctgccgccgccacgcagcagtatctgttttaatgtgttatatattgagggaggtagaactcccctcactaggggtttctatttcggaatgttacgatgctaatagagctcgcaagacgtgtttgcgccaggctggagatatggcgccgacgtgtccaacagcgccgctacaacttgcgggccgaagtaagagctgccaaaaaaggacggcgcaccgcgtgactcccatagctggccaactggacctacatttggtagagtactctttcgcctgtgcgatcgttcggacctaattacggcgtctacggaatgataatcacaaaagggaaaaagaaaaaagaaatcagtactctcatgatatcttcttcaattctttcatcactttggttttcatttacccaaatgcgtgccagtaatttcttaatcccggatgagatagaggcaccagaggaattagaaaattatatctttgaagagctctgcttccagtggcaaattgaatataacttaaggaacactagaatgtctaatatatatatagaaattaaaacaaaatagttgaatatttaaaataaatagttagagctacgaggttattgaaaaaaaatagttataaagtcagtgaaacagtatatagtttaaatttctttattcgaataatgcagcaccgatatgtcccgtgagactgattttgggtggaggatgggggagtcgattccctgcaaaccatccattccggtatctgggaagggcatccgccgagccggccagtcttcttaaagtaccaagtctttactccgatggatgatcgatcagccagatcttcattgcactatctagaagatcagttgcggcaaggctatgagctgcgaaggctcgtacggctatatgccttccttctctcatccacttagtgactccgttggtagtcactttcgcattaacacggcccagttcgttcatacaaacccccatcatgagtaaggacacatttgccaaggattcagcagcgtttgcccaattgatggcacccttcaggtccttttgaaagtcctcaaagcggcctccactcccagggtagaagtctacgtgtagggtgatacaatcatccgatacagatcgaaatcttctctttgcgggttagtccacacacccatcgtcttgatgcctagaccctcatagttcgaataagcatgtccatgaccgtgatgataagtggcatcgtcagcgaagactcgataataatcatactgctattctacacctcctatgtcttttcacaatgtcaaactagagtcaagctcaacagggtcttctttccccgctgattctgccataacttttcttatttctaaataaatataattttaaattaaattaaaataaactctaatatactaatacttaatctaatctaataaaattaatatcctgatttaaatataactaaaaataatataaaatttaaataattaatttttaaaagttatttctattctaattaagggtccggccccgtatgctcttactcaaatccatccgagaacatcaggatcggtcggagatgcgccgaagctctctcctccgttcactttcattacgcgtaggggtttgacacccgaacactcgcatacgaagacgactccttggtccgtgtttcaagactcgcgagcagtgatttggggaggagacatgactggggttgaccaagtgccagatatcagagtaaaggcgattttgtatgtagttggtttcttgcttagattcaatagagcgaaggggcaaggcaaaaaagagaacccctgaaactagtggaatgagcaatctttacatcccgcacatctccttctccagtatcttaggcgatatagccttcagggtagcttagaagagatgggatggcgggactgggtgtagcggggaaacaggacttttactttgaaaaaattagagtgctccaggcaggcctttgctcgaatacattagactgggtgtagcggggaaacaggacttttactttgaaaaaattagagtgctccaggcaggcctttgctcgaatacattatcatggaataataaaataggacgtgtggttctattttgttggtttctaggaccgccgtaatgattaatagggacagtcggaccaggcatcctcagtacgacgtaccgcacgcggccgctttcgtgagggtcgacgcccactatgaatcacccgccagcgcagccgaagccgtctagcctgtccaagtgaccactcagtgggaatctgcaagatacggtacagttgaagagatttcccacgagctatttatatagccagatatataaataacccagctatagctatagcccctaagaggggaagcttattatctaatagtaataactaaaaggttccatgtgaacagcggttggacgtgggttagtcgatcctaagccatagggaagttccgtttcaaaggcgcactgtgcgccgtgtggcgaaagggaagccggtcaatattccggcacctggatgtgggttttgcgcggcaacgcaactgaacgcggataaggtcaatatgctcatcccaccgtgatttcatgcatgctttcatctcagcaaaaaactcttcgatcgggttcgtgtcaggagtatacggcgccgtcatttccaacctcacacctgccttatcacacaattgcttgatctcatcggaacagtgaatgctggcgttatccataacgagcaaccgcagcaggtctccaaggtgaacagcctctggttgatagaacaatgtagataagggaagtcggcaaaatagatccgtaacaaccgcagcaggtctccaaggtgaacagcctctggttgatagaacaatgtagataagggaagtcggcaaaatagatccggaacttcgggataaggattggctctaagggttgggtacgttgggctttgggaggacgcctcgggagcaggcagccactagtgaacacatggaagcagtggggttgttgttaacaaataatggattaaccaacctagtctgttatttctcctatgacacatttttctgatatcagcacagcctctttgtgctcgcaaaccagtgacgaggatgaagtgctcgtaactacgaatactagcacaaaatttggatcggtcggagatgcgccgaagctctctcctacgttcactttcattacgcgtaggggtttgacacccgaacactcgcattgatacaggcttcttttggatcttgtaattggaatgagtacaatttaaatcccttaacgaggaacaattggagggcaagtctggtgccaacttcgaaaacatgtaggagcaaatgtgacgtaactgcaggatcgtaacagtagaaaccagatgttattattcgtattaccatttccataatccccttaatggttaatcgggcagggtgagaggataatgagaggatgcattggatcgagcaatgtcttttgcgtgatttggtacagcatgcggtcgttattgggcgccggattgacctgcaagataatcctgaaaaaccatttgttagggagttcttattgctgcgtgatcttattgaggcatacgacgaagcagggctgcagccggcgttagatctcacgccaattcataggggtggtgcgaaggaatacgagcgcctacttcaacagaaccgcaatgctatgttttaattagacagtcagattccccttgtccgtaccagttctaagttggttgttaaccgtacgccggccggccgaagcctgctaagggcatcagcacccaggtgctggctgccgccggccggttgcccggctagtggctgcctgctcctcataggtgcaccgacccacatttaccctcgtgcacgccacggtcggttcccgggccacttttgattttccgcaaaatgcatttgtatgggaaatcaaaaaaatcgactcacggccaccaaaccgcgcgaccgatatacatctatgaagatagagattctcggcacgaacaagcgttgtttgccctctgagtgtatatatatatatatatatatataaccaaattagagccaatttcaatcatttcaagaacagtacgatactctttgttcacatctatgaagatagagattctcggcacgaacaagcgttgtttgccctctgagtgtatatatatatatatatatatatataaccaaattagagccaatttcaatcatttcaagaacagtacgatactctttgttcatatttattagaatattataaatatatttattagaatattataaatatatttattagaatattataaatatatttattagaatattataaatatatttattaggcctcgggagcaggcagccactagccgggcaaccggccggcggcagccagcacctgggtgctgatgcccttagcaggctgcggccgtccggcgtacggttaacaaccaacttagaactggtacggacaaggggaatctgagacggtatctgatcgtcttcgatcccctaactttcgttcctgattaatgaaaacatccttggcaaatgctttcgcagtacttagtcttcactagcgggttctggaaccttatcagcggactctagacgtggaggcatacgccgttctcacctgtcccgaagcaaccactttcacctagatgtcattttaatcggcaaggtatcgaaagggtctgagttgttcatgtccaataattcactggagtatattggcagtggatgcctatgagagtcatcatccgtccttcagcatccttgccttggtaattatttgtcctggaaccgcaaacggcttaaatgtgttggcacttccgcacaaagtatattttgtttccataattgcattccgacgcaaagaccaagtagaagagagtcagctcgacgtcccttgaaaatccgcgggaaggaataattctcacgccaggtcgtactcataaccgcagcaggtctccaaggggaacagcctctggttgatagaacaatgtagataagggaagtcggcaaaatagatccgtaacttcgggataaggattggcctcgacgtcccttgaaaatccgcgggaaggaataattctcacgccaggtcgtactcataaccgcagcaggtctccaaggcgaacagcctctggttgatagaacaatgtagataagggaagtcggcaaaatagatccgtaacttcgggataaggattggcactcttccttcaagacggccaggcatatcgactgtacggtaagggtcttccacaaagaagactgctggtgtgggataaattgtgaatgtgttttactactttggtatgatcgaacttgataatagccatttttacagtgccatcttgttaccacatattgggacagcgacaatcgatactcgggtgagtcagctcgcagatatttgaaagcgccctccgtaagtttcaagactaattggtgtgtagaaatgcatggaggtcacaatgcttgacaatgtgaagaacggacttttccacccgttctcgaccgggccaatgatgagatcgaagtcgtcacagaccctcggttacaccagcatcccttccgaccatacttggtgtgatgttcacccttactctttgtcaaactaatcaaatctctccaccaagtcttatcgttagctgcataggtatcattgattttccgcaaaattcatttgtatgggaaatcaaaaaaatcgactcacggccaccaaaccgcgcgaccgatatacacgacttttgctggactactaataaggttggtctggattggattaagtactttaattcctatacagctcctcgtacgaagggggtattccgaatgctaatcctatgctgtaccaaatcacgcaaaagacattgctcgatccaatgcatcctctcattatcctctcaccctgcccgaggctgcgtggcggcggcatgctgtaccaaatcacgcaaaagacattgctcgatccaatgcatcctctcattatcctctcaccctgcccgaggctgcttggcggcggcagagattaaaggcccaacagtcccgcccagcaccttcccttcttagtgctcggctgggcaatgctactgtccagcttgtcagcttgtcagctttttggatccgataagcgttagatagcaagctcgctgagtacgccaaaaatgaaaaaaaaaaaaaaaaaagccaatccttatcccgaagttacggatctattttgccgacttcccttatctacattgttctatcaaccagaggctgttaaccttaagcccgataacctaataatagctctgctggtgacccggacccctgagggttcctagggcccgctaagccgtagcggttatagcgggctgtagccactgacccacagtggctgcgctcattcagataattggtttttgcggctgtccgaccgggcagtgccgcgaagctaccatctgctggataatggctgaccgcctctaagtcagaatccatgccagaaagcggtgataccacccgcacgtacagatggacaagaataggcttcggcttaagggtagctggttgtggtttctgcctacccggtaccccaacttcaaaccggtctcccgccttccacgcggatcggaggggagtgagaaggccagtatttcaaagagctcgcgaagctgattattctgaccaccacttcaaaaaaagtcatgtatatcggagggtagctggttgtggtttctgcctacccggtaccccaacttcaaaccggtctcccgccttccacgcggatcggagggcagtgagaaggccagtatttcaaagagctcgcgaagctgattattctgaccaccacttcaaaaaaagtcatgtatatcggtcggggaggtagtgacaataaatactgatacagggttcttttggatcttgtaattggaatgagtacaatttaaatccctgaacgaggaacaattggcgcacgcggccgctttcgtgagggtcgacgcccactatgaatcacccgccagcgaagccgaagccgtctagcctgtccacgtgaccactcagtgggaatctgcaagatacggtacagttgaagagatttcccacagcggatcggaccagcttgttacagaagctccctgtagccagagattcacatcatcgcatggactaccgtgtgcacataccttgaaaaagctggaggaagaaaggaagaccctcttgctagaacaatttcatcctcattggtacttgaagcggcatgtcacatgacctacactttacataacctgcacctcacataacctgcaccccacaggctatctcaccgcctgtagctcacgcccagtagaccggccctccctgtatctagccactgtcctcgacttacagcgcttcccaccctctaaaacaataatttaccgcacatgacctacactttacataacctgcacctcacataacctgcaccccacaggctatctcaccgcctgtagctcacgctctcattcaaatttcttccctatcaactttcgatgtttgggtattggccaaacatggttgcaacgggtaacggagggttagggccatattactactaaccctaagtattttattgccagatgtcctttggctaagagggtgtattaagctgtgaaggtcgatagacgtgtcttctatgctcgtaataagataataaaataagaaattaaaccttttctatacttattttattattttatatctaaaaataatattcttataatatatctttatttaaagtcgtcaagaagctgtcggattgagaggggttgattcgacgcacagtgataatcaggtacatgaagagggcacacttttagccccatcgactaacccacgtccaaccgctgttcacatggaacctttccccacttcggtccttcaagttctcattgaagtatttcctactaccaccaagatctagaggaaaatatccaggcaggctttattggatctggcctaatgccgtacgacccaaagagggttctttcaaagctagatatagcactgcgaacaccaacaccaccagagaccctgcctgagataaggcagccctgggttctaaagacaacctcagtccaccccagggtattacacagtgggctataacactcccgagggagccacattcccaaagcctttatcccccgttctgcctacccggtaccccaacttcaaaccggtctcccgccttccacgcggatcggagggaagtgagaaggccagtatttcaagaatcagcttctggacgatgctggcaatttggcgagggatattcatggccaggtctacccaatgtactcggcggagataccttattaatttattacttgaggaggatggggccgcttgtttggatgtttgagaaacattcattcacctattgtagtaatttcattaatcttccttaattactgacttatttcccaatcaacgctatatatctaacttcgggtttaagtagtccgcttccccgaatgactgcttggaaaattatgtaatcaaacagcaagcctccctagactctttggtaggccagccattgtaaattccaacccggttgcaattggcggttaacactttggcctgctttatggacagcagcttccaacagggcacttttcgccatttctggaactctaatgttcgacagcggtccagattgccccactctacattgttagctagcgtgcgacgccggtcaaagcttatgcgaagttgagccccaggcaatactagtttattatgttgtgggctttgggaaactgatcttagcttggatctaggcagggtatgactaaatcaagccatgtaggaattcactatcggacctcttgctccataatgcataccaaccttagacccttagacgccggtatgtataagtgatctgtctcacaacaataacactgagataggatggcagctgcccatgaggaaggattaacccacgcacatgatcttactgagtccaaacagtcatcacccattgatctaaaatccaagcctcaataccagagtgttgttatattgagccaaggtagtcggccgcaatgaattccgaggaagtcaatcctaggcgtcagcatcttagcaatggattcgataaccgttgagcagttagacatccaggcattagacccaatggcatcattcaggagcactgttatgagtttaatctagagcagttattgaggctttaaaacaagcaaacaaatgtgtgcggctaatgacagtctggcaagctcaccgtctactagttagtaaacatcccgtccggctagtggctgcctgctcccgaggcgtcctcccaaagcccaacgtacccaacccttagagccaatccttatcccgacgttacggatctattttgccgacttcccttatctacattgttctatcaaccagaggctgttcaccttggagacctgctgccgagatcctgactgcttcaggagggtgtattgcttccttgacgatcctagcaccagcccgttgcctctgactccctccataatattagtgggtgaacaatccaacgcttaccgaattctgcttcggtatgataggaagagccgacatcgaaggatcaaaaagcgagggcattggtttttaatctaataaatacatcccttccgaagtcgggattttaagcatgtattagctctagaattaccacggataacttccttacacgcgcaccgggtgcgcaacacgtgacacttatgtgcgcacccaggtgcgtacctattggtccccagactgaaaacatcattggctctttcgtgatgtatgggcagtcagaatttagttggttgaccaccgtacatttagactggatgagagatggacaacttcacttactccaataagcggcattgattggacactattgagtcaaaatctatttttgctgcttatctgctgacctatttactactttgttcgctatttcaacccgggctcacgccctaggcttcgtcactgacctccacgtccgcctactcctcagggcatcgtttctaccctgagtgaaactggatggcgctcaagcgtctcacccatacctcgccctcagggtagaaacgatgccctgaggagtaggcggacgtggaggggaagcggctgcagggtagccagtctatctttacatcccgcacatctccttctccagtatcttaggcgatatagccttccgggtagcttagaagagatgggatggcgggtttacaaaagtcatgtatatcggtcgcgcggtttggtggccgtgagtcgaaaaagggtaaaagtccccttgattttgattttcagtgtgaatacaaaccatgaaagtgtggcctatcgatcctttagtcgttcgacgtgtgaagctagaggtgccagaaaagttaccacagggataactggcttgtggcggccaagcgttcatagcgactcaaaggcgcactttgcgccgtgtggcgaaagggaagccggtcaatattccggcacctggatgtgggttttgcgcggcaccgcaactgaacgcggagacgacggcgggggccccaggaaggagatgtgcgggatgtaaagatagactggctaccctgcagccgcttcccgagagacagaccgggcgccagaactctcgcgtccttgtaatccatctcccaaaccccctacgcagccagccaccagggccgcctgtattggggaaatcgaggcgaagctggtgcgtgagatgacgatatcgagagcaaagaaaagggaagaaccaaatcaggccggctctcccggaagtactttctggagtactgataatgggggctaaaagtgtgccctcttcatgtacctgattatcactgtgcgtcgaatcaacccctctcaatccgacagcttctttatcactacttcgcagaggaggccacgacgggtccgccactagatttaggggccggccgtccctcgcgggctttggccgaaaggtcatcgatccaccgatgagactgctattccggaagatttgcaagggtcttgacgaacaacaagtgaagatatcactatcggctctacttacacacagcgttccattttgcctgcatcacgttgcacaggccttatatctggcgcatttctgttacggatcagcatcgatacagcagagatcggctctacttacacacagcgttccattttgcctgcatcacgttgcacaggccttatatctggcgcatttctgttaccgatcagcatcgatacagcagagaagtgtgttttgcatcggcctgcgccgatctgaagacgcgactaggccatgatgacagtatattagagtttattttagtttaatttaaaattatacttatttagaaataagaaaagttagttatataagattattagttaatttatctctataagtaaacttcatcgggctgctgctcctcaagccctgtgcctccctgaacattctccgctccgtggagcatcatcccatcccaactaccagcagggaaagaatggaaaagagctatctggagcggcctcagcagctccatttgccgtttctcacacgcttcctcctctacctggttggcctcatgctcagcccgaaaactccatcgctgcaacagtagagactgcaatttctcttcaatgctttgtctttcccctggacttgaatttttgtcgaacgagtccatgacattatgggaaatcaaaaaaatcgactcacggccaccaaaccgcgcgaccgatatacatgacttttgtaaacccgccatcccagctcttctaagctaccctgaaggctatatcgcctaagatactggagaaggagatgtgcgggatgtaaagatagactggcttatgaaggcacggattacctatattacaaaggaagatttcttccctgtatttctagaagcatttaatacctctataacccaggaaaatatcggaccaaggagtcgtcttcgtatgcgagtgttcgggtgtcaaacccctacgcgtaatgaaagtgaacgtaggagagagcgtcggcgcatctccgaccgatctgcgtgacatggtgattggcgggaaaagtgggtatcacacgtgacttgtatacgtgttggggtgaaattcgtaacacccgggaagcagctttagcgggttttagagtagtttttagtcggtagacctatgagagaaattagtataattttctgattatcaaataaacgataacttatataatgagccattcgcagtttcgccgtataattgcttatacttagacatgcatggcttaatatacgacagctgcacccgtctgcctagcgccatgccctgacacccgctacatccttgatcagctcagttctgtaagcacttatgcctatatcggtcgcgcggtttggtggccgtgaggcgatttttttgatttcccatacaaatgaattttgcggaaaatcaaaagtggcccgggaaccgaccgtggcgtgcacgaggattccacttgaaccagtcattggcattgtccagtgttgggatagcattgtagaacgcgccgaggccgaattgttcaaatttcgcaatgtccgtcatggtgagggcctgttcactggttcgattttgcgagctggcgatcgcacaggccacttcggctgctccttttctaaggggaaggcgctaaacataaaacctccgacgcagtctgtgcctagccctctgagtacggatttgagggttagcgacgtcaactgcaggagaagattgagatactgcgggcacatataggagctctgaaagcgggcgctcatatcctcatcaatgatgtggtttcattggcacaggaagtaactccaccctgggctgataagaagactcggtatgttcaacttttgcctgaagcagcactcagtgagctaatttggtgctgtgttcggcgcgctctcacgagtgccattcagtaactaattctccagtgcccctcgtgggcgctggtggccaaaagcagctttagcgggttttagagtagtttttagtcggtagacctatgagagaaattagtataattttctgatctctcttacaaaaataagattcttttgtactatattttgcactatattaggtccctctagcactaaaactcactgagtaatagcggagttagcagttgagagctgtaactgatatatatagcttttataagacccacttttatctgaaagaggctcttaagctgatcagttgagtatagatattagataagcgttcatgaccagacttgggcaggttgatcatccgtggttctccgcggtgcactctgcctgcccaggccagcatcaggtcgccccgggggataaaggctttgggaatgtggctccctcgggagtgttatagcccactgtgtaataccctggggtggactgtaactggccgggtgcttgcatgatcatggtgagagtgtctgggtgtgctatgtagtacctttccattttctggtcggagcagaagtggcgcctcagaggcaaacaccaggttccgccgagcggcttgcccaccctcctcaagccccgatgtcatcggtaaccccacagaccccgccttcccgaaagcgccctcgggacgacgcacaaccagggggacttctgactccgccagccacgaggactggaaagacagcagagcgggaggagcagcggcaaggaagacggcgatggtgaggtggccgggctcgaccagacgaggaggatagtagcacaggggatgtaaagatagactggctaccctgcagccgcttcccgagagacagaccgggcgccagaactctggcgtccttgtactccatctcccaaaccccctacgcagccagccaccagggccgcctgtattggggaaatcgaggcgaaggacggcttacccaaaaattgactcgttcggcaccttacgagaaatcaaagtgcttgggctccagggggagtatggtcgcaaggctgaaactgaaagaaattgacggaagggcaccaccaggggtggagcctgcggcttaatttgactcaacacggggaaactcaccaggtcaaaactataaattatatattaggttatagtaggtctatataagtagatagctattcttaagatatagcttttcttctagcatttgcgcgcctgctgccttccttggatgtagtagccgtttctcaggctccttctccggggtcgagccctaaccctccggtacccgttgcaaccatgtttggccaatacccaaacatcgaaagttgatagggaagaaatttgaatgaaccatcgccggccaggccagcatcagttcgccccgggggataaaggctttgggaatgtggctccctcgggagtgttatagcccactgtgtactaccctggggtggactgaggttcgcgctctgcaaggatgctggcgtaatggtcatcaacgacccgtcttgaaacacggatactttacataacctatactcaacataacctacactttacataacctatactcaacataacctacactttacataacctccacctcacatgacctacactttacattaaaaggtttgcaaacctttaaaaagaagactttctgtttcttaggccttggacataacccggctcgaccggacacgtgaacgagccgctcccaccagtttccactggcttcatagctagatagaacctattcgttagttctcgacaacaacacaatagtatatataaattataaaaatatttaatattttactataacttagtaatttaatagaagataaatatattatattaaatatttatttaaatttaattataaatttatatattaaaaagaattagaaaataaaaaagttaatatttttaattagaaatctaaatataaataaatagtttttaaaataaataaataactatttattataaataataaagaatacttaatatagaaaactttagatattatactaaagaaaataatatatattaaagtctagatagatactatactaaatataaaagaattttaatagaaaataagaataatacttattaaagaaatctataaatatttatttttagaatatataatagttagataacttatactgaacagggtctagggtagattagagttaaactaattagagtattattctgaatagtataatcaggttactataagctatataatataaattactattaatatataagtattatagagctagtaataatagatatatagataatattactatagattaataactttattaataactatctaaaagagtatttctatttagtaaaataaatatatatatatactaagataatatatataatatagaatatattattagtaattatttaatagtatagttaatatatagaatattaactatatctttctatttatatataattatatataataactaagaatagttttattagataatatagaggttatttataatataatactccctcctattagttttatttttaaaactatatttagcagcctagttagtatattatctaactttctttctttattatttatactaatactatattatttagttatattttaaaaataaaaatattaaaagctaagttatttctaatttatagaaatacttttctttttattttattctgaataatccttctattatactagtatattcttattataagagttataatagatattcttattagatatctccttcagattcttcctattatatagaatatatattatatagttaattatactataatatctagaggttatctatataatagatttattatattagaatctattattagcaggctaagaaagagctaaatatagtagaggaggagttagagtatataagtattaagatataatatttatataaataaaagaaaatatagtttaataagataatataaataatatcttatagtattaatagtattaaagaattaaagtagatagaatataagaaaatagagaagataacttataaggtagctttttctttagtaattatttcttcttctaagtttatatttttagagattaagattaatttagtatttctttagaagggtatagaattatttccttcttagtttattagaatagatattttaaatctaataatactattagataagtttctaataattctttagatatttagtaggttttaaaatattatttttattagtatattatttttatttaataaagtaacatatttatctatttctaattttcttttttagtattttttctagtttatattcttttttatagatcttaattaaatagttttaatctaaagtattttttagtatttttttaaataataagatataaaaaactatataaatatatattatatctactgtttccatttaaccccaattccacttcaataggccgttattatcagcctttttcagctgtacgaggcttttgaagatgccgcagttcgtatgattcctaccgaaacaaaatcccgacctaccaatctgctatgcagtcaagccaccatgccaagtcctaatgtagaaccaataatcctagtagatatttaaacactattagatatataccccaattaggataggtagatggagagaccgcggtctatcaccctgaaatcggtttgtccggagctagggtttaatggccggaagagcccagcacctctgctgggtctggggcgctctcgacgtcccttgaaaatccgcgggaaggaataattctcacgccaggtcgtactcataaccgcagcaggtctcatataatatatatatataaattaaatctatataatataaactatatagagaacttaaactagttttaatattagaataattataataattaatattctttaattatattattaaactattaaaatctagatgtgcgggatgtaaagatagactggctaccctgcagccgcttcccgagagacagaccgggcgccagaactctggcgtagatgtgcgggatgtaaagatagactggctaccctgcagccgcttcccgagagacagaccgggcgccagaactctggcgcccttgtaatccatctcccaaaccccctacgcagccagccaccagggccgcctgtattggggaaatcgaggcgaaggacggggaggagaggacgggctaccgacgattgacctcgagagcgtcttcaccgatcccgacatggctgctgactttgtcaagaagacgggcgtccacagctatttttacattttctaatggatggtggactaactttaagctacgaaataacctctcgagaagacgggtcacaagaagggctacgaagaccccagaagaggcagttccaatcgtcaataatttcctacgattcatccgcgtctactctggcaccttaacctcgcgttcggttcatcccgcatcgccagttctgcttaccaaaaatggcccactagtattcaaaaagcgacgtcgctatgaacgcttggccgccacaagccagttatccctgtggtaacttttctggcacctctagcttcaccccgcacatctccttctccagtatcttaggcgatatagccttcagggtagcttagaagagatgggatggcgggtttacaacccgcacatctccttctccagtatcttaggcgatatagccttcagggtagcttagaagagatgggatggcgggtttacacaagtcatgtatatcggtcgcgcggtttggtggccgtgagtcgatttttttgatttcccatacaaatgaattttgcggaattgaagagacccgcgagttcgcccgtcgcgatgccgttgccgatgcctatgccgacgcgtacgcttcttactacaagcgcgccaccgtcctccaggcccgtgctggttgcgtaagtttactcctagctcaaaccgtattcataaattacgctaaaacatcgccattcattttcagggctagtacattcggttggtgagttgttacacagtccttagcggattccgacttccatggccaccgtccaaattaccattgcggcgaggtcatcagtagggtaaaactaacctgtctcacgacggtctaaacccagctcacgttccctagtagtgggtgaacaatccaacgcttaccgaattctgcttcggtatgataggaagagccgacatcgaaggatcaaaaagcgaagagcccagcacctctgctgggtctggtgcgctctcgacgtcccttgaaaatccgcgggaaggaataattctcacgcccggtcgtactcataaccgcagcaggtctccaaggtgaacagcctctggttgatagaacaatgtagataagggaagtcggcattacccaatcccgactcggggaggtagtgacaataaatactgatacagggttcttttggatcttgtaattggaatgaggacaatttaaatcccttaacgaggaacaattggagggcaagtctggtgccagcagacaattgaatactgatgcccccgactgtccctattaatcattacggcggtcctagaaaccaacaaaatagaaccacacctcctattttattattccatgctaatgtattcgagcaaaggcctgcctggagcactctaattttttcaaagtaaaagtccctcactgagtaatagcggagttagcagttgagagctgtaagttatagcgaacttccctgctgcgttatagcggtctcaatgcccaataccccacgtccaaccgctgttcacatggaacctttccccacttcggtccttcaagttctcattgaagtatttgctactaccaccatgctcccttccccaccctctgcctttgcccttctgcggccaccgcgaaatttggcgagtcaatttgaactgacgacacaggtggctttacctgaagaagtcatgtatatcggtcgcgcggtttggtggccgtgagtcgatttttttgatttcccatacaaatgaattttgcggaaacaggcggtgagatagcctgtggggtgcaggttatgtgaggtgcaggttatgtaaagtgtaggtcatgtgaggtgcagggtatgtaaagtgtaggttatgttgagtataggttatgtaaagtgtaggttatgttgagtataggttatgtaaagtataggcggttatccaagtagtaaggtactatcaaataaacgataacttatataatgagccattcgcagtttcgccgtataattgctacagtggcgtgcattcgctgtggttggatttgtggtggtgtgggtgcgctgtggttgattatgtagtgggttgggtgcggtggggttggaattttagcggggtgatacacgctatggctgacttccagttgcttatgtatactgttgtgggttgttttactctcttaaggtagccaaatgcctcgtcatctaattagtgacgcgcatgaatggattaacgagattcccactgtccctatctactcagtagtgatctgggctgccgaggtcgggtggctcgtccagtcaatgctgtttacacaggccttcgtcagcttggttgtgttgaagacctcttctgcttcgtcgcattcgaagggaggcactgcagacggagggagcaaagttgaggctatcgcaataacctggctatgcgacggagcattgccgagagcatcttgaattcgtatccatccagctaattcggtctcctgcttccttgagaggcgttgacgggcttctaggtaaagctaatgattagggacccgggggctatatattgccttcatccattctcaaactttaaatatgtaagaagctcttgttgcttatatgcctgtatagggtgaagccagaggaaactctggtggaggctcgcagcggttctgacgtgcaaatcgatcgtcaaatctgggcatgggggcgaaagactaatcgaaccttctagtagctggtttccgccgaagtttccctcaggatagcagtattgacatgctaatgtattcgagcaaaggcctgcctggagcactctaattttttcaaagtaaaagtcctgtttccccgctacacgcagtgaagggcatagggttccacagagggaaaggcccggccggaccagtacacgcggtgaggcggaccggccagccaggtgaagagtacccaggctcatgggagggcgtcccgcgggcgctgcagggtatgtaaaatcaaaaaagttgttaagagccgcggcccgaggcgtcctcccaaagcccaacgtacccaacccttagagccaatccttatcccgaagttacggatctattttgccgcattgttatctccagcgagaacgtctttcggcctggcgataatcagacgtggtatagcgcgagtaaggcggctgtctctttagcaactaaatctttagcgcttgagtttgctaaggatcaactccgctttaacactgtctgccctaacaggagaccggccccctacggggcccgccagcagacctttcggaacgagactttctggactgtggctatagagatgtggcttgagaaggttcgattagtctttcgcccccatgcccatatttgacgatcgatttgcacgtcagaaccgctgcgagcctccacccgagtttcctctggcttcaccctatacaggcatagttcaccttctttcgggtccggccccgtatgctcttactcaaatcccccaagcttctctgcctcctcccaccggccttgattcgtatatgttgatgcgagattggccatactcgccagtgtatcgagatggtctgctccaagcttcatcttacgagcctctatcacctgcaacccaagcttctctgcctcctcccaccggccttgcaacggatctcttggttctggcatcgatgaagaacgcagcgaaatgcgataagtaatgtgaattgcagaattcagtgaagcatcgaatctttgaacgcacattgcgcccgccagtattctggcgggcatgcctgtctgagcgtcatttcaaccctcatgagtagagtagccttgttgttacgatctgctgagggtaagccgtccttcgcctcgatttccccaatacaggcggccctggtggcagtagagtagccttgttgttacgatctgctgagggtaagccgtccttcgcctcgatttccccaatacaggcggccctgggggctggctgcgtagggggttccaccacagcgtgcatgcaccaccacaaatccaaccacagcacatgcacatcgccgggaaccaaacttcagcacatgcccgaccgatcctgatgttctcggatggatttgagtaagagcatacggggccggacccgaaagaaggtgaactatgcctggatagggtgaagccagaggaaactctggtggaggctcgcagcggttctgacgtgcaaatcgatcgtcaaatatgggcatgaaccgcgcgaccgatatacatgacttttgtaaacccgccatcccatctcttctaagctaccctgaaggctatatcgcctcaagtcgggattgggtaatttgcgcgcctgctgccttccttggatgtagtagccgtttctcaggctccttctccggggtcgcgccctaaccctccgttacccgttgcaaccatgtttggccaatacccaaacatcgaaagttgatagggaagaaatttgaaacagacgttattgaccttgaatagtagctcgcggttctgtatatgtggatcgcgatctatctcattgcgaataagctgccggttctcctcctcttcatcgtcgctaacgtcagggagaggctgcgttggcgggaaggcttcgaggttgatctctaattgctgctctttttttatcggcacagcctgcttgcgtttgcgtgatgtgagaggcttttcaacttgcgcaggctcttgtgttattactaatatctatactcaactgatcagcttaagagcctctttcagataaaagtaggtcttataaaagctatatatatcggtcgaaggttttcaccggcccaacccgctgtggctgcccgttggggcaattgcgttagcggtcacaaccgctgtaacggccgctgtggcgatcgtattagcgatctcgtattgcgctgtagcagctgcattagcggtcctcgtatccgctgtagcagctacattagcggtcgaaatctccagtagaacaaaagggtaaaagtccccttgattttgattttcagtgtgaatacaaaccatgaaagtgtggcctatcgaaatctccagtagaacaaaagggtaaaagtccccttgattttgattttcagtgtgaatacaaaccatgaaagtgtggcatatcgatcctttagtccttcgacgtgtgaagctagaggtgccagaaaagttaccacagggataactggcttgtggcggcccactattcaatggttcttcacaagtcaaacgatatatggtagctcttttttctttggctcattagagcgatcgtcccccctcttcccccaactgcagctacggcagctgtcgaagtgcccgatttgttccggatcaggcaagtactctctcatgggattgctacttcggctggctggggtatgtcagttggtatggagggcgaaatgcctggtgttgcctggcttcagggatttcagggaagctgtcgaagtgcccgatttgttccggatcaggcaagtactctctcatgggattgctacttcggctggctggggtatgccagttagtatggagggcgaaatgcctggtgctgcctggcttcagggatttcagggatcgaaattgtcttatattcattggaagagcgaaaggccaaccaagggcgaggagtgagccgttccatctgcagaccatgagaacgcaggggtggggtagcgagggaggtaatggacgactttgggaggtgatgacaggctggccgggtgcttgcatgatcatggtgagagtgtctgggtgtgctatgtagtacctttccattttctggtcgaaaattcaaaaaagtgacaaaccacgcccaataaagaccgcatgctgtaccaaatcacgcaaaagacattgctcgatccaatgcatcaagtcatgtatatcggtcgcgcggtttggtggccgtgagtcgatttttttgatttcccatacaaatgaattttgcggaacatcaaaaaagtcatgtatatcggtcgcgcggtttggtggccgtgagtcgatttttttgatttcccatacaaatgaattttgcggaagatcaaaatagttttactataaataaaggtatattctaagatcaggtaatatataatctaatatatattttttaagaatataattagcagtctatatctgaacctttaatactataaggggcgctggtggccaaccccggcgaacgatagttacctggttgattctgccagtagtcatatgcttgtctcaaagattatacgcctttcgaaacgatcccttcagtattccttagcctaccctataggctgtacctaccctagacccagcttaccctatagctggtctaccctacggttcccgggccacttttgattttccgcaaaattcatttgtatgggaaatcaaaaaaatcgactcacggccaccaaacagcgcgaccgatatacatgacttttatgaggtaaagcgaatgattagggacccgggggctatatattgccttcatccattctcaaactttaaatatgtaagaagatcttgttgcttaattgaacgtgagcattcgaatgtatcaatactagtgggccatttttggtaagcagaactggcgatgccctccacgaagtgcaaacgcgtcacacgaagcagcctcgcgtcagaagtctatggcatggtggccggcttcgacgttggtgtcacgatcgcgagcacgctccggattttttaattttattttattatagtatttttttattcttttctaaagaaattctaattctatttttattttaatatataataacaatcctcattgtgtctggacctggtgagtttccccgtgttgagtcaaattaagccgcaggctccacccctggtggtgcgcttccgtcaatttctttaagtttcagccttgcgaccatactccccctggagcccaagcactttgatttctcgtaaggtggatagaactgtcttgaggagtggctgtcgctgtacaaagcgagaggcccaattgatgccaacgcgctccgcgtcgcggtcgcgtagcagtaagttcgccattcctacctgatctgaggtcaaccttggaaagttgggggtttaacggcaggggctcgtcgctctccgatgcggaatatcactacttgattttccgcaaaattcatttgtatgggaaatcaaaaaaatcgactcacggccaccaaaccgcgcgaccgatatacatcactttttgttgcttaagataatagaacaatatcaaatctcgccgcctcgggtcactgttacggatcgcgaactcgctctgatcaatgctatcgaaagtcagcctgctctcaaagactcggtgaaccttctctgctgttggtatattaatatgaatgttcttgcgaaatgtaagagtatgtttcccggcgcgaagagagttaacggcgttgttgaacgagacccttctttccaagcgtttcttcaagattggggcaccaccgtcctccaggcccgtgctggttgcgtaagtttactcctagctcaaaccgtattcataaattacgctaaaacatctttggaaatatagactggtgctcgtggtatctgtgtcaatggcgtctgcaaggttaacaatgtcggcggtgggcttcctgaggctagacggcttcggcttcgctggcgggtgattcatagtgggcgtcgaccctcacgaaagcggccgcgtgcggtacggcgtactgaggatgcctggtctggggagagctctgctctcgccggcgctggatgggttctgtggatggatggccgctggcatggccttgcgccggcgatggttcattcaaatttcttccctatcaactttcgatgtttgggtattggccaaacatggtttcaacgggtaacggagggttagggctcgaccccggagaaggagcctgagaaacggctactacatccaaggaaggcagcagctaagacctagtctagggtaggctggttatagggtagcctggtataggttaggtcgtctgagaatatcctaggattttttccggattttctagacccttatctgggctagataagcccgataacctaataatagctctgctggtggcccggacccctgattaatttacctctataagtacagtatatatttactactatagaaggtttttattaggaataatacagatttaatattaacctgatacttatttatataacgtgatccaccaccatgtgggccataccaccatgtgggccacttttttaaactttataacttctaattattaaagatagactggctaccctgcagccgcttcccgagagacagaccgggcgccagaactctggcgtccttgtaatccatcccccaaaccccctacgcagccagccaccagggccgcctgtattggggaaatcgaggcgaaggacggcttaccctcagcagaaagatagactggctaccctgcagccgcttcccgagagacagaccgggcgccagaactctggcgtccttgtaatccatcgcccaaaccccctacgcagccagccaccagggccgcctgtattggggaaatcgaggcgaaggacggcttaccctcagcagttgagacaagcatatgactactggcagaatcaaccaggtaactatcgttcgccggggttggccaccagcgcccacgaggcgcactggagaattagttactgaatgaaggtggtggaaatgtggatggtgaaaaaagtgttcggttgtagggggtgttcggttgaccagggttacaacttatgttactggtggtagggaagaaaagaaatgggtcccacgtgacctctgccccttgtcagcgtagattcgtaacaaacccacaccaccacaaatccaaccacagcgaatgcacgccactgtaaattccaccacagcgtgcatgcaccaccacaaacccaaccacagcacatgcacatcgccgggaaccaaacttcagcacatgcacctcactgggaatgccaccaaagcatattcgagaccggctttatgatgggggttatcttccctggaatggtggttactacctcagagggtcgtacaaaggctaagctagtccagcctggtaaccgggagtcttctcatagccgtcaagagaccacatgaagttaggccccggcacgcggaagttacggcgatatctgagttgggcgtcacgccggccagcaacttcctcaggaaaaatagctgaataggcagaataaagccggtgttgtgatataagaaccttgccttgctgacgcacataggcacaaagaagcctgctaagggcatcagcacccaggtgctggctgccgccggccggttgcccggctagtggctgcctgctcccgaggcggcctcccaaagcccaacgtacccaacccttagagccaatccttatcccgaagttacggatctattttgccgacttccctttacccggtaccccaacttcaaaccggtctcccgccttccacgcggatcggagggaagtgagaaggccagtatttcaaagagctgacttagaggcgttcagccattatccagcagatggtagcttcgcggcactgcccggtcggacagccgcaaaaaccaattactgacttagaggcgttcagccattatccagcagatggtagcttcgcggcactgcccggtcggacagccgcaaaaaccaagccggccggcggcagccagcacctgggtgctgatgcccttagcaggcttcggccgtccggcgtacggttaacaaccaacttagccggccggcggcagccagcacctgggtgctgatgcccttagcaggcttcggccgtccggcgtacggttaacaaccaactgaggccagcatcagttcgccccgggggataaaggctttgggaatgtggctccctcgggagtgttatagcccactgtgtaagaccctggggtggactgaggtatgtgatgaagccggtgtttgggcccttccggccaccttcaactcctccctcaactcctccaaaggccgggataaagcgtaaagatccattgaaccaactcaaagcgccacccgcgcaaatactccgtgagattatagtaaacatccgcaacccactcaccgtagcgagcctacgggcgatgaacccgcgtagtctaaaggtagcggattgggacaatcccgaccttccactcgccacgatcgtgaagctcttcatgatctacaataatcgtcgagccggtgatagcagtagctacagagccattgagatcaggcggccctggtggctggctgcgtagggggtttgggagatggattacaaggacgccagagttctggcgcccggtctggctctcgggaagcgaggacgccagagttctggcgcccggtctgtctctcgggaagcggctgcagggtagccagtctatctttacatcccgcacctctccttctccagtatcttaggcgatatagccttcagggtagcttagaagagatgggatggcgggtttacaaaagtcatctttaatatacgctattggagctggaattaccgcggctgctggcaccagacttgccctccaattgttcctcgttaagggctttaaattgtactcattccaattacaagatccaaaagaaccctgtatcagtatttattgtcacgatgcattggatcgagcaatgtcttttgcgtgatttggtacagcatgcggtctttattgggcgtggtttgtcactttttgtcgatttccggtggcaatattgattctctcggcctgtggttggggtggccatcgagtggctgtgcctgttggctccggatttcaaaaccttactcaggttatctcttctaattctaatagagaagaaaagattaaaagagaagaaatagctagtaaaatagaagttgataaagaagaagattttaaatcttctaacttagaaactaaaactaatactagtttaacctctgctttaaataccaactaagaacggccatgcaccaccacccacaaaatcaagaaagagctctcaatctgtcaatcctcattgtgtctggacctgtaagcatatcaataagcggaggaaaagaaaccaacagggattgccctagtaacggcgagtgaagcggcaacagctcaaattatagtatattagattataataattattaagtactagagaaatattattataattctctataagtatattaagtattaggtttatttatatatttttatattaattaattattaaataaagtaatagttctaataaatataattactagatctatatataaaagaatagctttattattataagtaagtttataatagagtataaacttaaataattaatatttaaaaaaagattctaatagttattattaataactattattatatatataaaaatctagttacttataataattaaattctaattatagggaataattatattagaggtatttattattattattataataaatagttagtaataaatagttataaggagagatagttaataataataaacttagagagatattataattaattataaataataagtatttctctttagagcttataattaaattatatatttaataagctttttttagagtttttaaagttattattatttatattttaactaactatataataaaaagtaaaaaaaaatagagttaaaaattagatatagattagaacttaattaaaaactaattatatagattatattatatatagtctaatcttagaatattacttcttatatatagtaaaaacctttaaaattttttttaatagttataactattataatagctactatagtaattatattaataatcttatattatattatagtagctatattaataattcttatatctattatagtaattatattagtagtttttatatctattataataattatattaatagtttttatatctactatagtaactatattagtaattcttatatctactatagtaattataaatctatattatagaaaataatatattatttttagagcttttaaagctttaaaatatctataaatataaagttttctctttattaaatagagattctttaagctaataatttacttttttatttactctatagtttatctttttagctattctatagctaataaagtttttctttcttacttagtagtttatcttttttattatatcttttaaaataatccctttagtatttcttagtttactctataaattatatttattctagatctagtttactctatagttaatctattttatattaaaaatcttaactttttaaaagattataagtttaacttttagttattttaatagaaaaatagctttatttctagatttaaaaattcttctactctatattagaattactttatattagagaaagttttctaatttactttatattttaatctagattttattagctttctttattaaagaaaatctaaaataactaataaaaataattatatagaggaattagcttctaaagatattaaaatctactcttttttaatagctattttaataattagtattattattataactagctaattaaatctttttagtattattaatactatttctataataaaaagtattattactatttagagtttataaaattaactaattaactttaatattattaatattatctctctagatcttataatagaaaatattactattatttaaaatctttagaatctaaatactattaaaactatttttattatatagtaaaccctttaataactaatagttattataaatctactatagttataatagacttttagtattattagtactagttaactagcttttagtattattagtactaattaatagtttattttatagagcttttaaagttttaattttttaattagaatttttaaaaactctattattaagaattttaataaaagagtttataaattctctaaagtttttaaattataaaaaccttataattttaattagtagaaataagctctagagatttaatttagagcttttagattattactacttatagtaaattttattatagcttaataattattaaatctatactaaactattttatttatattattaaaagatagctatatagagaaactataaactattataatttaatagattttccctatagagatctataaattattaattaaatagttcttttataatattaaaatttaatatagctatctatatatctaattttataaactttattataaaaactttaaaagctctttagaagtttttaataatatatttaataatattctaactagattattactagctaaaattactataatctctatagattaaataaattagtatttaaaggttttaaaagagattttcttataatagactaaatactaatagaataatattagaattactaaagcctttagaggttctttagagtttttaaacttatagttttttatagtaaactttctagagaaataatataataagagctctttaataattaaaattactaattataaaattaaatatattaaaaagtctattaaaagaaagtttttaagttttaaaaagatctttaaagaaaaaacttaatagaagagatttaaatttaaagcttctaaagaaaaactagttaaatttactaattttattttaaattataatttagaaaatctttaaagcttattagaaaataataataaaaaaagctttaactagctttttagatttattagttctttaaatctattaaaattataatagttcctattattattagctttagtagttaaagatataatctactaaatatccttctatataatatagactctatagtatacttaataaataataaagcttattataaagattataaagctttaaaatactctaagataaactatattttaatagctattagtaagatttactctatagatattagaactattatatttaaaattctaatctcttagaactttctaatctatagagagttagagctaaaagaaattctttttctatttatcttaaaaactaatatagttagtaaaataaaatactatagcttagaaagtacttttttaagataatagctatttatagataatagaacttattatagtttattaaactttaaaaaatatagcttttatttatagctaaaagagtaaaaaacccctaaacttataatacttaaggagttctctatttatactagttatagctactctatagagatctaaattccttttaaaacctttaaataaacccctaaggctttaaactttatagggtttagtaagtttattaaatttattaaataattccctaataaacttactaagcttattaaatagcttattaagaagtttattaagctctttaaataatatattaaataatctattaaaaagcttattagagtatttattaagattttaatttataagcttttaaaaagaaattattataattttaatactaaaaaaatcctaatataaagaactattaatactattaagcttttattataaatatctaagatctataaaaacctattataattaatagatatctaatatatataattagagtatttagagctttaattactaaagaaaactattaaaattataaaaggtttttctaattttaactctataaaaaagaaagattttctctatttagtttatattaatactaaaagctataggtttctagagtatataactatttctaatttatttagagctttaaactctatagaaagagatattttctatttaagtttatactatatttttttaagggtttttactatatataaaaagtaatatcctaagattagactatatataatataatctatataattagtttttaactaagttttaatctatatctaatttttaattctatatttttttactttttattatatagctagctaagatatagataataataactctaaaaactctaaaaactttttattaaatatataatttaactataagttctaaagagaaatacttattatttataattaattataatatctttttaaacttattattactaactatattaaatctatattatttctaataaaaactttctataatagtaaatatatactatacttatagaggtaaattaaagtttaaaatattaattttaaattctattttttttatagaattaaatatctatgatataaattctaaaagtatttaatttttaattttattaaatactttttactattttagggattcattgcaccctgcgggacagcctcgagctcgacactgcaggctgccagatcaagaagcagtgtatattggaaggcgagctgctggtatggaatgatgacgacgggagaatcgagcctctccacaaaatccgcaaacatgtgaatcgatctgggcgatttcttggaactgctcgagattcacccgtcgacttgaatgagcatctcatgatcatgttctacgatatcctgttattggatgacactgcctgcgtcagagagagccatgatgagcggcgacgagtacttcaatctctggttcactccgttccgggccgggccgacatcggatcccgtgaagtacttgaattctcctcttttgatgcagccaaacagctcagtgaagcattctctcgagctattacagaacggtgggaaggattggtgttgaagggttgcgacgatccttacccctcatccgaggagggcaggtcctttatcaaacttaagaaagattacattccaggccttggtgacactgccgacttcgtcattgttgggggacgccgggacgcaggagatgcacaagggcttcgaattggtaagctatggtggacatcattttacattggatgcatggaaaataaggatgaggtctgccgctataatggaaagccgagatttcgcattgtcgatgtcatcgacaagcacggcatctcgaaagaaaacctcatataccttaaccgccatggatacttcagacgagtgcctttcgccgaggttatacccgagttcaacgtcgcactcgacccaggacggagactgcagccagtggatctcttcagagagccgtttacagtagaagtggtcggtgctggcttcgcaaagcctgcgaacgctcggtattatactctgcggtttccacgagtattgaaggtccataatgatcgatcgttcagggattctatcagctttaaagagaacaggagatggctaaaagatgcgtagagatgccgtatgatcaggaacaagaagagcgaagctggtttaggagattgggaggttatgagcaggttgttgaaggatcgaggacaagctctcccagcgacgactcggtttctgtcgcagatgttcatgcgggtaggcaaggcatccgacaacaggaaaaggtggaaacggcagttgggcctctccgcccagaaaatatttccattcctccattaaagcgggagagggccttggagctcttgcatggcgactcaactttcaagcgagcaaaacgagacgggatatacgacgattcgaaataacagtctctagcgacattggccttgatcagagttattgggccaaataaacttgattgtactgtacaatacctaaagtcacgtccccacagcattgttcccacatctgggaacatggggccaaaattgacgccctgggtccagttttggtccctaagagctaagcataacaaaccacattgtcgagtgataagaatgaccacgatcgtccctatttcaggccattcctcatgtatgcttttgggcctagaatgtgctgtcgaacaaagccatcaccgaccagcttacgtgcaacccgaggaaccggctgggatgcgcagcagacccatgtcggacccgacactgagtggcagaaatagggtaagtggcccagaatttgggcctgtggtcccagaattggacattggtgccatggaactggtcgtagaggccgacgctacgagtaaatggaccgtgctttctcttcgttgcccgccttcctatggaaacagtcgattgcctgatgtcaccacctccagtccttctaggctggagaagaactataccccaagagggttgagggaaggctgccctgggccgtggcctgatatcgacatcagtaagtaaaaaggggagggtagctcacaccatgttgatgtagatcagtgagtctatgtacgcccttgatctcccatacatgttgtagggtgggagaaactggaccgctaggaggaaccatagcacgatagcgagattgaaggcggggatggtgtaaatggataagaaggaaacaattgactgtcctgcgtacgctgcacgtgtacgatagctattattcagtgaatttaaataaagatgataaaacgaatatgaagcaggccattacaatgaaggcaagaagtagcaagatatgtagttcaccgtttgagcatcattaactgcactgggcaaagtaatcaacccttcctttaacttcggcaacgccatagactagaggcagtcgactgagccgcagggaggctgaattgggccagggcagctaattcaaataaatgcaagcgcattattcaagggtgaaaagtcacaaatgcgcacctttagaccaaccatttcgggggttcgctatatccatcatccaaccagcttgaggatagtattagatgtaaaaggcccagtctccagggagacggtacacttctctctgtctaatgggagcttatggcattgaggccagcaatacgtccaaagacgagtgcccgcataacggccactgcatttggagccttgtcgtagaaatggccagtaatctcacctgcagcatatagattaggaatgatgcctctctggccaagaacgcgcgcttccacatcagtcgcaataccgccgaaagtgtagacaatggccgcggctaaggggaatgcggtatacggcggagcgtcgagcggcctagcccagttcgatttcgatggttgcaagcctgaggtagtggcgagattatcaagccggcccgccgtaaagccagacatgtttgcgttacaggctgcattatagtttaagattgtgttcagaagcgcttgttccggcacccccatctgtgccgccagaccagaaatcgtgtccgccgtcaccggcggcatatcggagcggatagctgcctcatggtcctccaattgaaaaaatctggaatcacaaattgcccaggctaagcggcccggtgtgtcaaaatgtatggttctggaaagatgctcccacgtgtcatgcacgagtccagcaccttcatctacgaaccgctttccctcctgattcaccacaaccccgtacgggtaattgaggaccagtggcgctggctgactgctccgtgggtcgattacttcgctgtgcattccgttccaatcgccagaggccttggctccgttggccagcgccatctggatgccgtcgccggcgttccaggccgtcccaggtgatatcggtctcaacgtctccgcaccaggaccaagatgagtacgcagcatgtctggactgccttgaaacccaccactggcgagcacaacagaccgggaaatgattcgtcgcccatcagctgcttcaactatggcctgtcctcggccaagatgaagtcgctgggcacggcaattatacaccagttggacacccttcgatttggctgattgcttgagggcttcgacaatggcggcacctttgccaataggctggatcctgttaggccaagatttcaagaaatagtccatggcgtgaaactgcaccccctgcttttcgagccattggagggcttcaggggcctggctagccagcctttcgaaatacgcgcggtcgccaccacttccgcttgcagccaccatgtcgtccacgaagcctggtaatacctcattgacagatggcattcgcatgttggcagggctccagcgtgagtttccaccgctcgcatgctctggtgcatgctctagcacggctatctgcgccgagggcgagagttctgcagctgatactgcggcggcgaggccggcaatgccatgaccaactacgacaaggtcgtacatgctgatatactcgagtctgaaaatcttagaggactaggcttcagggtgttggtggtctatgtctgttggaacacttcttggttgcggtattattagaaaattgaggctctcacgtgcaagcttcagatgctcgcggagactgagactaagacggctcagctcgccgcagtttaagcggcgaaggattgctgcggcgcgccagtgggacggacgttggttaagtcgccaccctagtcaatcgcctacctttaataattgaattatatattataactgtatatttattaatataaaaaatctataaattaaaaataaagctatttaaattactagataaaatatagctctttaaagatataattctctaattcctaaactaagatcttaatatctaattaatccttataatattcctttatattaataatattagatatcttaataaagagtttatttagatctagataaataatatatcttttctttagctatagtagtttaattaacccctttagatatatattcttagtatttaaaataaataattatatttactatttatctaaacccttatagatcttatagaatagaagttagataattagatttatcttttttttatatataaagttttatattaagctataaaactagtaactcccttttagagtaattattataatctcttttctttttattctagttattagtataactaatagtattaatagctagatttaaaagatatattaagaagaaagtatatataaatttaataaggggattataatattaactagttatattctagatattttctagcctattaatatattagaatatattaaaactatttatctagctagataataatatttaagaaatataatctttctaattaataataaatctatttatatttattattataagagataataataataatttctctttagaatagaaaaaataaataagttaaataattataaaatatattttttttctattagttttactataaataaaaatatattctaagattaaataatatataatctaatatatatttttttggccagaagggactttgaccggtccgggaaatggctgccagcagttgcaacgaccgctgcaagtgcatcattcgtgcaggaaacctaatggaggattatgacgtcgagatcagacgaattaacagtcttgcagcaagtaggttgtcctcctttgcctcattccttggccttccgtgagcaatttcctgcacgaatgatgcacttgcagcggtcgttgcaactgctggcagccatttcccggaccggtcaaagtcccttcttatgtaaagtgtaggtcatgtgaggtgcaggttatgtaaagtgtaggttatgttgagtataggttatgtaaagtgtagggtatgttgagtataggttatgtaaagtataggttaggtggcgtgtgttgtgtgtgaatatgctttggtggcattcccagttatggacctctgcatgaataaaagtcttggtcttcctgtcgaagatctgtttacggatctccgattcgagcccgtatttttgaagctcagcaatatcatcttggaactcttctaggtcgtcttcaggaaaagcatagtgcagtacgtctgttaatctcggaaggcaccaggagagccccaagcaaatgcagcaaatgtcacgccgttggccacataatgacctcaaagaactgtcctctaagatttcaagacttatcaagacaggtgttaaacgaagagtcaggtcaggctttatcccggggagtcactccacagccggattcagttgctgttcccatcatgtaaagccttcgatttcattaatgtattggggaggaatctggaagacaggaaggacacctttggtcttgatgcatcgcgatgaaaacgttcgatcggattttccttgtattgtcttcgtgcctttgacctcgtacgtatagccatccagatattcaaaaggtataggtgtctcatcgatattgacgatacagccacgtcggaagcgtcgggttggtgatatcgtcacgaggatacgatcgagggcagtggatcgttggttggatatccgtcggatgaatcgtaggaaattattgacgagtggggtgcaggttatgtgaggtgcaggttatgtaaagtgtaggtcatgtgaggtgcaggttatgtaaagtgtaggttaggttgagtataggttatgtaaagtgtaggttatgttgagtataggttatgtaaagtataggttaggtggcgtgtgttgtgagtgggtgaacaatccaacgcttaccgaattctgcttcggtatgataggaagagccgacatcgaaggatcaaaaagcgacgggctgaatatactttttatctaatttgcttcccgcctgggctattagttgtgaagttattcagggttgaagttgacctataattgggcagaatacctacttctgtctctctccctgaccacgcgcaactgtggtctcatctgagaagataacccgcttccaccacgataggggctttcttatcaagcatgcagcgacaattcccagccaatcatcggttgcttagaatactgtgaacttcatttctgattggccgactcgctcacgtgaccattctcaccaaattgtcccgggctctagctcgactcaaggcaagatgtacatacagcagaggctagaatacctatagcatccgtcgccagcggtagcgccagcatcttcagttcctctcctccttccacctccaattcctgctctcggatcattccatataatctaatatatattttttaagaatataattagcagtctatatctgaacctttaatactataagataaagttaaatattatacttggatgatgaaaggagggatagcccagccagctgcatttaccccttggatcacagttgcccactcccggttaccaggctggactagcttccacaattgccttttgctgctcatccaccggcccgttgcagcggtaccagcggtcgaggtagtcagagagtccgatttggcatcccttacccacacaagctgctcctccgacgcccaattcgcctctagatagctcatgccgagcgacggatggatctttacatcccgcacatctccttctccagtatcttaggcgatatagccttcagggtagcttagaagagatgggatggagggtttacaaaagtcatgtatatcggtagatcgactcgatctaccgccaaagacccatcaaaagttgtcacaaacagcgatggtgctacagttgtgaaaccgcaaaaggaggtcgatctgcgatcgaccaccaaaagcccatcaaaaaggacgttacaaacaccgatggcgttacaattgtgaaaacaacccacaacagtatacataagcaactggaagtcagccatagcgtgtatcaccccgctaaaattccaaccccagcccacccaacccactacataatcaaccacagcgcacccacaccaccacaaatccaaccacagcgaatgcacgccactgtaaggtttggtggttgtgagttgattttttagatttcccatagtaatgaattttgcggaaaatcaaaagtggcccgggaagcacgggtccgccactagatttaggggccggccgtccctcgcgggctttggccgatccccaacaccacgccctaggggcatgcgggttgaacgggtccgccactagatttaggggccggccgtccctcgcgggctttggccgatccccaacaccacgccctaggggcatgggggttgaaatgacgctcagacaggcatgcccgccagaatactggcgggcgcaatgtgcgttcaaagattcgatgattcaagccagcgtactgccaaagcaatacgggctagttagcaggttaaggtctcgttcgttatcgcaattaagcagacaaatcacccaaacttcagcacatgcacctcactgggaatgccaccaaagcatattcacacacaacacacgccacctaacctatactgtacataacctatactcaacatcctccacgaagtgcaaacgcgtcacacgaagcagcctcgcgtcagaagtctatggcatggtggccggcttcgacgttggcgtcacgatcgcgagcacgctcagaatgatcacttcaaaactgtcactgccggaaatacccctcgtaatctgtacagattcactctcgctgtacgaatgtctcgtcaagctggggacccatacctcgccctcagggtagaaacgatgccctgaggagtaggcggacgtggaggtcagtgacgaagcctagggcgggagcccgggttgaacggcctctagtgcagatcttggtggtagtagcaaatacttcaatgagaacttgaaggaccgaagtttagacatgcatggcttaatctttgagacaagcatatgactactggcagaatcaaccaggtaactatcgttcgccgggggtggccaccagcgcccacgaggggcactggagaattagttactgaatggcactcgtgagagcgcgccgaacacagcaccaaacaggcacatgccgccgcaactgtggcatttttgagccttttatccgggctaaggtagatgatacagctggtaagaacctgtggcattatgacgtgagttgaatgacccctccacaatcgataagcgctcactgaggatgtgggggggagtggcaaatgcatcgtgtccatggacaagtatcgtgcttaatctccccaagggaaactatatatatttgcttttgtgtatattaaactgttggcgtttaccggcccgcctcagtacttgtttggctagctgttcaactgttgagaacttgctattcgggttaggaagcaatcgagtccgttttttcggcctaagtatctcatacgattagccaagatagtgaatgggattgaaggcttatagtaacgactaaattataatgactgagcgcaaagaggtgacaaccctcttttcaaagtgcttttcatctttcgatcactctacttgtgcgctatcggtctctggccggtatttagctttataagacgtatacctcccatttagagcagcattcccaaactactcgactcgtcgaaggagtttcacagaggctaggcatcctggcaccagacttgccctccaattgttcctcgttaagggatttaaattgtactcattccaattacaagatccaaaagaacctctctccgagagaccgttggaatatggatgaagccggcattatggagggagtcagaggtaacgggctggtactaggatcatcaaggaagcaatataccctcctgaagcagtcaggatggcgtacggttaacaaccaacttagaactggtacggacaaggggaatctgactgtctaattaaaacatagcattgcgattgccagaaagtgccccagcgcacccaacccactacataatcaaccacagcgcacccacaccaccacaaatccaaccacagcgaatgcacgccactgggttggatgcctagcctctgtgaaactccttcgacgagtcgagtagtttgggaatgctgctctaaatgggaggtatacgtctgaatatattaaattagattctagagtttatttatctactaatagggttttcttaatattagatatatttaaatataagttgtcatgccacaaacagggatcagacggagtcgcctataaaagggctggaaacagccagtagatagaaggaatcaagcagcggcagggccaccgacgccgcgcacggcaatccaccttccccctctcagttccccagggcatccttccaccacaccacgaccactagggccggtgcggcttgggcgccccaagaggagtgctcagcgcacagcttcaaccatggcggtgtccgctgctagaggagcgggcggttgggcaggacgccgcgcaggaccatgacgacgataaaagtgatgaggaagaggccgatgaggagaagtccttccctttcgccacacggcgcaaagtgcgcctttgaaacggaacttccctatggcttaggatcgactaacccacgtccatacgctttcaaaccttcaacttcgcaaaaatgaagtttttcgctaccaccattctcattgccgctacttctgtcgttgcaaattatgacccttgcccgcccctctttttgcagttcctctctgctgcaagactgatgttcggtgttcattatcttgaatagtaattgaaggctgcgttctggcctgtatttaacttgaacaaaaatgatacaagcattagtaatgcgaacttaagagttcagaaattacccaggagtccaggaaatggtgctacccttgttcttgggaacgtgagctgggtttagaccgtcgtgagacaggttagttttaccctactgatgacctcgccgcaatggtaattgagctgggaacgtgagctgggtttagaccgtcgtgagacaggttagttttaccctactgatgacctcgccgcaatggtaattgatctttgcttatgtatactgttgtgggttgttttagtagggtaggtgccctgtaactggccgggtgcttgcatgatcatggtgggagtgtctgggtgtgctatgtagtacctttccattttctggtcgaaaattccaaaaagtgacaaaccacgcccaataaattgcttatgtatactgttgtgggttgttttagtagggtaggtgccctgtaactggccgggtgcttgcatgatcatggtgcgagtgtctgggtgtgctatgtagtacctttccattttctggtcgaaaattccaaaaagtgacaaaccacgcccaataaagacggagtttaacaagattacccaggcctttcggccaagggagtactcgctggctccgtcagtgtagcgcgcgtgcggcccgacggagtttaacaagattacccaggcctttcggccaagggagtactcgctggctccgtcagtgtagcgcgcgtgcggcacagaacatctaagggcatcacagacctgttattgcctcaaacttccatcggcttgagccgatagtccctctaagaagccgacaccgccatggttgaagctgtgcgctgagcactcctcttggggcgcccaagccgcaccggccctagtggtcttggtgtgctatctcaccgcctgtagctcacgctcagtagaccggccctccctgtatctagccactgtcctcgacttacagcgcttccctcatatgagtcactggtacgaatgagctcgtaaatcctggccaatgaaaagcgagcccactgatcagattcctccaagggactcccattctccccagctactaccgtcccaccatttatataggcaggcgtttttatccgtcccaactctgaaaagatccagccgattggaactccaagaccccgcggaaatcgggaaatgcgccacatgtcatggagaccatgaagcctggagcaaccattgcccggaccggaaggaagagatgaatagaattaaagcggcatatctcacaagaccaaggctccacccagagccagccactcgatggccaccccaaccacaggccgagagaatcaacattgccaccggaaatcgaccgactttcaggctcatgggagggcgtcccgcgggcgctgcagggtatgtaaaatcaaaaaagttgttaagagccgcggtaaattatttcgccgccgctgctacaagttcagcagctgaccacctccgcaagtatgagaatacgacgtcgcgagcttgagcattattcaccacatgtaggtctcacaggatcttgatttttgaatctatcgcgattttcatctgggtgttcggttgaggggggtgttcggttgaccagggttacaacttaagggacgactggatcattgggatctggctatgatcctcatgatccaacccacggatcattgaccaaacctcatgatcgcaggcagagtgcaccgcggagaaccacggatgatcaacctgcccaagtctggtcatgaacgcttccctttcaacaatttcgcaagtatatgtgcgcatcagaactctcgcgtgtatgattgacttggcgacttgggcgtacatacccactcatcgatacgccatgttccattcgatcatcgtccagctgctgatggcagccagttctctacccgtctctgtctcggccgacgaagtaaacggtgtgtacaaagggcagggacgtaatcaacgcaagctgatgacttgcgcttactagggattcctcgttgaagagcaagaattgcaatgctctatccccagcacgacggagtttaacaagattacccaggcctttcggccaagggagtactcgctggcttctcgagctttatatatatcactaggaaatctaatttccttatttttatttttttttaatactactataaaataagtaataaaataatcttttatttaattgtaacatctaaatagaatttaataggaataatattcttcatatttatttatatttattccagcctccgcacatgaacttgtatcccaagtggcgccttcccgataatgcaagcgaagaggtgttggaagacctcatagacaagatgcagcagaatacgctcagtcttattacagacaagcagccgtactataaaaggtacgattcgagaaccgattaggtgtggatgaccttgacaggtgtggatgaccttgacaggtgtggatgaccttgacaggtgtggatgaccttgacaggtgtggatctcttcctttcgtacagctttcttctactcctttacagaggaaaatatccaggcaggctttattggatctggcctaatgctgtacgacccaaagagggttctttcaaagctagatgtggcactgcgaacactaacaccaccagagaccctgcctgagataaggcagccctgggttctaaagatactacagactgcgtacgaggcaagtatacagtctgagcatattaaatcccgaatctcagcttattaaaatagctctccaacctctatgctggctgcaatagattatctgtacttgcggagccttgtctagcggccttttctcacacttcttattggacaattcatcgctattcctttgcatgaagcctgtgtgggctaagacaacccacagtcgttactgcagttgagacagtggggctccattttggatgagagagagcttgatcacacggtgtttcaggtaaagccacctgtgtcgtcagttcaaattgactcgccaaatttcgcggtggccgcagaagggcaaaggcagaggatggggaagggagcatgacgttgttagattccatcggactaagcgtcgattaggaaggaatggcacgcgtcggggagaagcttaagagagtcatagttactcccgccgtttacccgcgcttggtcgaatggcttcgctttgacattcagagcactgggccgagccttgagcaccagtctgcccgatagggccttcaggaccagtatcaccagtttcaccttgagggccttgagcaccagtcagaccgatagggccttcagatatgtaagaagctcttgttgcttaattgaacgtgagcattcgaatgtatcaatactagtgggccatttttggtaagcataacttgtgtccagggacagccagtgtgtccagggacagccagtgtgtccagggacagccagtgtgtccagggacagccagtgtgtccagggacagccagtgtgctcctcagctcccgaaccataccgaccgcggtcttgcttgcctctgcggcctcttttgcggcaatctttgcatctctaacagcatcggtattatcttgcatcaaccccgaggcttgttctcacatttccgtccagtaactctgttctccatctggccctattcgtgccttgggaacgctttctttccgacatgcacggcgatgttgccgatttatggctcggatacgaagcttctctctgtcaccggctacgttttcacgtactatatgcttatttcatatgctcgtaacctttgactaaaatcgcactgccacaacatgctagagcggttagttgcggtgcataccctcctcatgcataactatctctcctggctccctccctagctggatgggtgcaaattcaagatgctctcggcaatgctccatcacatagccaggttattgcgatagcctcaactttactccctccgtcagaccctctaatacgtctaggaaagcactggatggagggctttttgaaacggaacccggaaattaagatattacgaggcaagcgaattgatctctacatccaaggaaggcagcaggcgcgcaaattacccaatcccgactcggggaggtagtgacaataaatactgatacagggcatgcaccaccacaaatccaaccacagcacatgcacatcgccgggaaccaaacttcagcacatgcacctcactgggaataccacagggaaaggcccggccggaccagtacacgcggtgaggcggaccggccagccaggcccaaggttcaactacgagctttttcaccacaacaactttaatatacgctattggagctggaattaccgcggctgctggcaccagacttgccctccaattgttccagaaggagcgagccaaccaagagaaggagcgagccaaccaagagaaggagcgagccaaccaagagaaggagcgagccaaccaagttgctgcagcgccttaggctttcgccttcagcactcgcgcccctctctcataggtgcaccgacccacatttaccctcgtgcttccctggaacgggacgccatagagggtgagagccccgtacggttggatgcctagcctctgtgaaactccttcgacgagtgtgatgttcacccttactctttgtcaaactaatcaaatctctccaccaagtcttatcgttagctgcataggtatcagagtttgtagtcagatgccgtggtcgccgtggattttgtacatcgtttagtggaaagaggtaaaatagagtataaatagaaactctaacagtttagaggtagaaggcaatggtacccactcaacttcagcgctgcccacaaatcaaatgcaatcaaacaaacagccaaacaaatcaatcaaatatgccagaatcttatcccaaataaccaaacttcagcacatgcacctcactgggaatgccaccaaagcatattcacacacaacacacgccacctaacctatactcagctccaatagcgtatattaaagttgttgtggttaaaaagctcgtagttgaaccttgggcctggctggccggtccgcctcatatatatatataaattaaatctatataatataaactatataaagaacttaaactagttttagtattagaataactataataattaatattctttaattatattattaaactattaaaatctcgctggctccgtcagtgtagcgcgcgtgcggcccagaacatctaagggcatcacagacctgttattgcctcaaacttccatcgcccgactgtccctattaatcattacggcggtcctagaaaccaacaaaatagaaccacacgtcctattttattattccatgcccgactgtccctattaatcattacggcggtcctagaaaccaacaaaatagaaccacacgtcctattttattattccattctaatgtattcgagcaaaggcctgcctggagcactctaattttttcaaagtaaaagtcctgtttccccgctacacccagcccgactgtccctattaatcattacggcggtcctagaaaccaacaaaatagaaccacacgtcctattttattattccatcctaacagttacagggcacctaccctactaaaacaacccacaacagtatacataagcaactggaagtcagccatagcgtgtatccccccgctaaaattccaaccccagcgcacccaacccactacataatcaaccacagcgcacccacaccaccacaaatccaaaggcctgcaggctaactgtcccaatccccatcctgtacatgtaagtatgtgttactatcaccaaatccgttgggaatgtggttattggcgatggggtcgtttcggtgagcagtgcaacagggaataccgcataggccagacttgtggcctcatgctggtctatgagaccgaagaacaacctacaggcctgcaggctaactgtcccaatccccatcctgtacatgtaagtatgtgttactatcaccaaatccgttgggaatgtagttattggcgatggggtcgtttcagtgagcagtgcaacagggaataccgcataggccagacttgtggcctcatgctggtctatgagaccgaagaacgcactactatccctaccaaatgaattacaggcaacaatcgggagaaaccttcatggacctgatttagttaatgcattaggttttggtttacaggttgacgattcaacaagacttcgtgcacagcattcatttatatggtctttttttctcagcccaaccaacctggtaagccgttacatgcaacccttgatacagaaattaaaaagcaatggtgtcgaaatggtgttgaaggcttggcagttcgtaaaactgaccaatgaaatagtgtacgatgtgataacgtccaaccgctgttcacatggaacctttccccacttcggtccttcaagttctcattgaagtatttgctactaccacccagatctgcactagaggccgttcaacccgggctcacgccctaggcttcgtcactgacctccacgtccgcctactcctcagaacttttctggcacctctagcttcacacgtcgaaggactaaaggatcgataggccacactttcatggtttgtattcacactggaaggattttcgcaatgccgaagcgctgaacgaaatggatttccaataaatccgccattgatgagtgctgtataaaggtggatgtgagcttgcccatcgacgccgttcatccgtcgtctttccggcaggaatatgaacgtttctacagccggaaagccggcttcgatgacgtgacgactgtagatatccgatggctcgcgttgctcttcattgtccttgctattggagcatacctggattgtccagccggcgcacggggttccgagccggatctatgacaggatagagagagatgaaccatcggcatgggaagaaacgcgaacagcgcatagactaacccttgcagacacatagtctagggagaatgtaatactttaagtttattttaaggctgtgcatatttgatagccagaagtataacccaatccgcttcgtcttgccgtcaggccaacacaaggcaaaaaagttaccatctggtccgacggagtgaggccgaacatttcctgcgtgcggcgagggctccatgggttatcccaatcttagagcgatgaattgcaaccggaaatgaggtaatacatctgttaaaccataacgcaggtgtcctaaggggggctcatggagaacagaaatctccagtagaacaaaagggtaaaagtatctgttaaaccataacgcaggtgtcctaaggggggctcatggagaacagaaatctccagtagaacaaaagggtaaaaggccccttgattttgattttcagtgtgaatacaaaccatgaaagtgtggcctatcgatcctttagtccttcgacgtgtgaaatctcgcttgtcatggtatgggattctcaagacacgctctcaacctaacgggcagggtaataaatgccgtcagttggctttgtctacagtagcgtttaatcttgccattatatagggataagtgggaatgcagctgactctttcatctctcgctaaactatacgaatatcggtatggcatggtagtcaacgttttgggggtggcttgctccccagtgtggaatgacaacgatccgggtctgagagccggaggccttgcggcatttgggtatgatgatattacatatcgttcgcttgggacacttcaaaaaaagtcatgtatatcggtcgcgcggtttggtggccgtgagtcgatttttttgatttcccatacaaatgaagtttgcggtaataaaataatattagataaagaaataatatttatttctaagttttaataattacttatagtataaatagatataaaatataagcttttaatagcttactatctataaagtaatagaaagcctaaggcgctgcagcaaaccactcacagcgtctcgggtcaactgtaacaagctggtccgatccgctgtgggaactctcttcaactgtaccgtatcttgcagattcccactgagtggtcacttggacaggctagacggcttcggcttcgctggcccgcccaaaaatgggatccaagccaccttcttgtacctcagtcgctccgtattgtcactatggcaatcattcttttattcctggtcaccaggtatgtatacatattctcgctctcacatgcctctgtatcgtcttcagcctcgccctcatatgcctctgtgccattctcaccccctctcccttgtgcctcttcgtcgtccttgccctcgccctgctctccaccgactaaaaactactctaaaacccgctaaagctgcttcccgggccacttttgattttccgcaaaattcattactataatgagagaaattagatagaattttctggtctctctcacaaaaataagattcttttgcgctatattttgcactatattagatccctctggtactgaaactcactgagtaatagcggagttagcagttgagagctataagttatagcgaacttccctgctgtgttgttacgatctgctgagggtaagccgtccttcgcctcgatttccccaatacaggcggccctggtggctggctgcgtggggggtttgggagatggattacaaggacgccagagttctggcgcccggtctgtctctcgggaagcggctgcagggtagcactttagcccatccggaatgtgagtgtcggcttgtacaatggagagtgaagtagtcagaaccctggtttacagcggtttggttggcaactagcaactgtaaagcaggtatctcgtagttagggttcgtaaagtcatctattggactcaccactggacatggccatatcgggtatttagcatagaagtggagcacgcataaatattaaataagttaggagcatgaatgaagtttattacgcccgggaggatttacctcatctccttgaagcttcgtagggagcacccaaattaggcgaacgcgctgtcgaatcaaagacgcgcattccgctgattttacagatttgaattacaggacggtcttttatatactttgtcataacttgtgcaggggataagcctctggtacgtgcccttcataagcggaactcaatcccagcgcaccgggccccaacccagtacccctggaagctagaggcctcccgtcggctcagatacgctgcgcatctatcattaaagaatgatatgtatataaatactaaaaacaatacatttgtccaccgcgacttgaagataccacatacctagcgtatatcgctatctatataaaagtaagggacgactggatcattgggatctggctatgatcctcatgatccaacccacggatcattgaccaaacctcatgatcccctactatatatgcacattcatttcttagctagaaacatgcacatcgccgggaaccaaacttcagcacatgcacctcactgggaatgccaccaaagcatattcacacacaacacacaccacctaacctatactttacataacctatactcaacataacctacactttacataacctatactcaacataacctacacatgcacatcgccgggaaccaaacttcagcacatgcacctcactgggaatgccaccaaagcatattcacacacaacacaccccacctaacctatactttacataacctatactcaacataacctacactttacataacctatactcaacataacctacacgtgtcggcccgcgaaggaccttaaaaccagaagttggacgtaaatccagccccgcttcattgaataagtaaaaaaacaatacagagcgcgaacctcagtccaccccagggtattacacagtgggctataacactcccgagggagccacattcccaaagccgttatcccccggggcgaactgatgctggcctgggcaggcagagtgcaccgcggagaaccacggatgatcaacctgcccaatctgcccgccttttctccattcaccctcgcccttttcctcttcctcttccacttcctctttagatctaccctcccccgcccctcatgggcggcggtttactcccgctcattagtgtctctgctctccctgagcatccgcacttggattccgctattgcgggaatatgatttttattcaacgtgccacgtggggtcgagtttcccactgtccctatctactatctagcgaaaccacagccaagggaacgggcttggcagaatcagcggggaaagaagacgctgttgagcttgactctgacagccttgataatgcaacttaataattactatataaattcaactccaatagctatgaaaattataccattatgatcaactcgtcacgataattatggcggtatcggtattatcgtcattagaggttcgtggcttctgtacgcgctgcctcttcctcctcaattcgtcaagcccacctccgactgtccctattaatcattacggcggtcctagaaaccaacaaaatagaaccacacgtcctattttattattccatgctactttcgttcctgattaatgaaaacatccttggcaaatgctttcgcagtagttagtcttcaataaatccaagaatttcacaaaaagcaatggtgtcgaaatggtgttgaaggcttggcagttcgtaaaactgaccaatgaaatagtgtacgatgtgataaatcggggagagtgggtcttataaaagctatatatatcggtcgaaggttttggtggttgtgagtcgattttttagatttcccatagtaatgaaatcccaggtagatagagatgcctaaccccggtacgggtaacacatacctacgaatctctgctcctaaaaatttcggcgtggacggcatatgtcccgtaactacacaaaaataaatataaataaatatgaagaatattattcctattaaattctatttagatgttacaattaaataaaagctacacaaaaataaatataaataaatatgaagaatattattcctattaaattctatttagatgttacaattaaataaaatattattttagtacttattttatagtagtattaaaaaaaaataaaaataaggaaattagatttcctagtgatatatataatacaaggacgccagagttctggcgcccggtctgtctctcgggaagcggctgcagggtagccagtctatctttacatccctcatcgttgatgaccattacgccagcatccttgcagagcgcgaacctcagtccaccccagggtattacacagtgggctataaccggccaagcgttcatagcgacgtcgctttttgatccttcgatgtcggctcttcctatcataccgaagcagaattcggtacgcgttggattgttcacccactaatagggaacgtgagctgggtttagaccgtcgtgagacaggttagttttaccctactgaggctatatcgcctaagatactggagaaggagatgtgcgggatgtaaagatagactggctaccctgcagccgcttcccgcgagacagaccgggcgccagaactctggcgtccttgtaatccatctcccaaaccccctacgcagccagccaccagggccgacgcagacatcctccccgccagccaaacccccacattacgcttgtttcactgcacgatcgaacaccaaacaataacatcgcctgctcccgtgattaatctccggcatgagagcatccttgggaagatggttccgacggcgaatccaccgaggagctgaacgaaacggatttttgggatgggaatatgttcatcgcaaccagcaaatcggtttgccggctttgccacttctacttccagaacgatgacaatgagttcagcgtccagcctccgctcagacccggatcgttgtcattccacactggggagcaagccacccccaaaacgttgactaccatgccataccgatattctccaatgcccagggccttgccattggcggagttgatgacggtgatgaggtccggaacagccgcaatcactgcctcacttccatcatgaagcttattatctaatagtaataactacctttcctttctaacttaaagcttactactaattacttaattaattaattattaaatacctagtaagtaagctataatatctaatataaatattctaatctcttagagcctggttaatacttctaataagatccttaaagtaataatagcgggcctcctgtgctcgtaaagtttgagccaatcaagtcccaaaattgtggccgctcgtgctcgcctaggcaaggtttacatctggcttcaccctatacaggcatagttcaccttctttcgggtccggccccgtatgctcttactcaaatccatccgagaccatcaggatcggtcggagatgcgccgaagctctctcctacgttcactttcattacgcgtaggggtttgacacccgaacattctggttttaaggtccttcgcgggccgacccgggttgaagacattgtcaggtggggagtttggctggggcggcacatcggttttacagatttgaattacaggacggtcttttatatactttgtcataacttgtgcaggggataagcctctggtacgtgctcttcataagcggaacgagcaatggcagccggcgaaccatcaacattagccacttgagggaggcggtcatcgtgcggtaaggcaagtaactagctttgggtgcatcagtgcacagcaattttaacctctatagaggcaaggtttgaggcttgctgcagaacaaaatagaaccacacgtcctattttattattccatgctaatgtattcgagcaaaggcctgcctggagcactctaatgttttcaatttctgttctccatgagccccccttaggacacctgcgttatggtttaacagatgtgccgccccagccaaactccccacctgactctgaagagtacccaggctcatgggagggcgtcccgcgggcgctgcagggtatgtaaaatcaaaaaagttgttaagagccgatccagatattcaaaaggtataggcgtctcatcgatattgacgatacagccacgtcggaagcgtcgggttggtgacatcgtcacgaggatacgatcgagggcagtggatcgttggttggatatccgtcggatgaatcgtaggaaattattgacgaggcatctgagctacatcaaggctgctaagggcgagactgatgtccctgaaggcgccccggaatttctgagtcaacgtcgtcgatggctgaacggttctttcgccgagtcagaatccatgccagaaagcggtgataccacccgcacgtacagatggacaagaataggcttcggcttagcgtcttacctcaagaagcgattgtgctccagtttcgaaaccataacaagaaggtcaatcacagatcgaccgccaaagacccatcaaaagacgtcataagatcaatcctcgccctcagggtagaaacgatgccctgaggagtaggcggacgtggaggtcagtgacgaagcctagggcgtgagcccggggtgatcgcaaatattgccgtcgatcctcccaaaaatagttggagcgagctgtggaagatctggattttcataactatttggcaaatcccgtgtgtgagaaactctaatgaaaaagcatgcatttaaggtccttcgcgggccgacccgggttgaagacattgtcaggtggggagtttggctggggcggcacatctgttaaaccataacgacacttccaaccaccttccctacacctgcggcagatcggcttctcttcgtcgcattttttacgacgcgctctaacatttcaattagaacactgtagcaaatattggcaggcaaaccgaatttggccagaagggactttgaccggtccgggaaatggctgctcgcgttcggttcatcccgcatcgccagttctgcttaccaaaaatggcccactagtattgatacattcgaatgctcactttcaattaagcaacaagagcttcttacatatttaaagtttgagaatggatgaaggcaatatatagcccccgggtccctataggttatgttgagtataggttatgtaaagtataggttaggtggcgtgtgttgtgtgtgaatatgctttggtggcattcacagtgaggtgcatgtgctgaagtttggttcccggcgatgtgcatgtgctgtggttggatttgtggtggtgcatgcacgcccccggcggccgacacctgggcgtcgtacacggaggtgccgtcgatctgcatctgcagctggcacacgccgccggactggcgacggtcgaggaaggctcgcttgccgttgcctgaggggccgactacgatggtggcgagccctgatgctctcgccgggcttgacgtcggcgggttcttgggcctcgggcggaagaatattgcatactcagtggtaggactggaaagacagcagagcgggaggagcagcggcaaggaagacggcgagggtgaggtggccgggctcgaccagacgaggaggatagtagcacagtggaaggcacaggcgaaacccgggcgaatgatcatggcccgcgctcctcagctcccgaaccataccgaccgcggtcttacttgcctctgcggcctcttttgcggcaatctttgcatggccgaggatagcaagtcgtgtctctgttgtaatgaagcaacggttgataagatggtaatagaaataggtaaaaaaatttttttaccacgatttcattttcaattcaacgtagtataaccctacgaaaactcctcaatgacgctacgcgggggcgtggtgttggggatcggccaaagcccgcgagggacggccggcccctaaatctagtggcggacccgtcgtggcctcccagtgggaatctgcaagatacggtacagttgaagagatttcccacagcggatcggaccagcttgttacagttgacccgagtcgctccagttatgaaagatagctctgaaaagaaaaacatccgcgcctgtggctttctgtgttttaaacatatcgtgtgcttcaaatataattcggtacccttatctgggctagataagcccgataacctaataatagctctgctggtagcccggacccctgagggttcctagggcacgctaagccgtagcggttatagcgggctgtagccactgacccacagtggctgcagccgctattggttagtgatcgtaataagaaagagctctcaatctgtcaatcctcattgtgtctggacctggtgagtttccccgtgttgagtcaaattaagccgccggctccacccctggtggtgcccttccgtcaatttctttaagtttcagccttgcgaccatactccccctggagcccaagcgtggtgatctatttgctagcctcgttgcagctagcctcgcggccacttgcaatttccccctttcacaatacaacgaaaataacgcacctcctccagcgttatggctactcaactccttgtttctcacctacataacctatactcaacataacctacactttacataacctgcacctcacatgacctacactttacataacctgcacctcagggggtttgggagatggattacaaggacgccagagttctggcgcccggtctgtctctcgggaagcggctgcagggtaggcagtctatctttacatcccgcacatctccttctccagtatcttaggcgatatagccttcagggtagcttagaagagatgaccacatcgtcgaacacgggtcttatcccgtggcttccgaccccgacccaagtgctcttcctgggtaatctgactattaccctcctgttgggctactatatcctgtgattcctgtacatttaaggatcctccttgtcgtagacgtgtttttttagctctgcgaatattcgtatctgttagaccgatcaatcgagcctttgcataacactgaaggaaggtcatcttgctgattggcgataaatcaattagaatatccttcttcgcaagctcctcgcgataggctctcttgaccggcgaaaagactgatatatcaagcggcccggccagttacagggcacctaccctactaaaacaacccacaacagtatacataagcaactggaagtcagccatagcgtgtatctcctcagggcatcgtttctaccctgagggcgaggtatgggtgagacgcttgagcgccatccattttcagggctagtaccttcggtcacaatgcttgacaatgtgaagaacggacttttccacaagcagcttctcactcctgtcccggaacatgcgcaaaccgctagataaactcaagagagtttactttttcatgtttaatttgcttgtacagagggtagaaagtaatatcaatgcatatcaatacaaggtactatcaaataaacgataacttatataattagccattcgcagtttcgccgtataattgcttatacttagacatgcatggcttaatctttgagacaagcatatgactactggtttcagccgctatgcagttacgcagctatgcccggtgagcgaagtccggcaaacagccgaagcgccgcagataatccgtcacgccccacttcgccatcaagggaagatcatttccacgccctgtgagaaaggcgccggccgactacactatgaaggatgatgatgatagtacttctacccaggtgctggctgccgccggccggttgcccggctagtggctgcctgctcccgaggcgtcctcccaaagcccaacgtacccaccagcttgttacagttgacccgagacgctgtgagtggtttgctgcagcgccttaggctttcgccttcagcactcgcgcgcctctctcataggtgcaccgacccacatttaccctcgtgcacgccacggtcggttcccgggccacttttgattttccgcgcacacttctagtaccgtagagtaatcgcctgctaagacgctaagccgaagcctattcttgtccatctgtacgtgcggggggtatcaccgctttctggcatggattctgacttagaggcgttcagccattatccagcagatggtagcttcgcggcactgaggatgctggcgtaatggtcatcaacgacccgtcttgaaacacggaccaaggagtcgtcttcgtatgcgagtgttcgggggtcaaacccctacgcgtaatgaaagtgaacgtaggagagagcttcggcgcatctccgaccgatcctgatgttctcggataggatgctggcgtaatggtcatcaacgacccgtcttgaaacacggaccaaggagtcgtcttcgtatgcgagtgttcgggtgtccgcgcgaccgatatacatgacttttgtaaacccgccatcccatctcttctaagctaccctgaaggctatatcgcctaagctactggagaaggagatgtgcgggatgtaaagatagactggctaccctgcagccgcttcccgagagacagaccgggcgccatgaagacgagcccctccgagaagaagaacccctctgagatgaagatgagcgattatttggctgccgccgtggagtcacattagttacttcaagatcgaaggcctctggccaaggcaggttgcagaaagggcaagaatccgaaaaggtgaagcatttgcgaatctcacccatttcgccttttactgtagtaacccctatggcttttaatatttaggtgaaaactcagtatcaggatactgtaaattctccctgtaactcgattttctctggaggaagctatcattcgactgagagcttctacaatacgtgctaacataacccatttcgccttttactgtagtaacccctatggcttttaatatttaggtgaaaactcagtatcaggatactgtaaatccagctgtccatcgccaaagtgagtaaattctccctgtaactcgattttctctggaggaagctatcattcgactgagagcttctacaatacgtgctaacataccacagcggatcggacgagcttgttacagttgacccgagacgctgtgagtggtttgctgcagcgccttaggctttcgccttcagcactcgcgcccctcggggctctctggtgattcatgataacttctcgaatcgcatggccttgcgccggcgatggttcattcaaatttcttccttatcaactttcctgctttaactatagtggaagttagaccccagtcttgggaatgtatttttggatttatacacagctaaaactccgcttgataagaactgaagagccgacatcgaaggatcaaaaagcgacgtcgctatgaacgcttggccgccacaagccagttatccctgtggtaacttgtaggtatacgtcttctaaagctaaataccggccagagaccgatagcgcacaagtagagtgatcgaaagatgaaaagcacttgcaaaggctcgattgatcggtctaacagatacgaatattcgctcgggctggaaggggtccggcttgtggcctgttaatgttgcaaaggctcgattgatcggtctaacagatacgaatattcgctcgggctggaaggggtccggcttgtggcctgttaatatccggatatttcaacgcccaagggcagtcaccaggtccggaagatcattcgcgattttatcgatgacaaggtcatcgatccaccgatgagactgcttgacggaagggcaccaccaggggtggagcctgcggcttaatttgactcaacacggggaaactcaccaggtccagacacagataccagttctcaagatgatattgggcagctaggatgataaaaggagggatagcccagccagctgtatttaccccttggatcacagttccttcatcatggccctcaagcgcctgtaggcatgtgcctgttcctgcatcccagattctgattgttttatcatgtgaacctttctcgtaaggtgccgaacgagtcaatttttaacatcgtccgatccctagtcggcatagtttatggttaagactacgacggtatatcgataggccacactttcatggtttgtattcacactgaaaatcaaaatcaaggggacttttacccttttgttctactgtagatttctgttctccatgagccccccttaggacacctgcgttatggtttaacagatgtgccgccccagccaaactccccatatcccgggttctcataatataatgcattcctgccaccaatagtgtgtcttgaagggtggctgcattatgtataagacgagagagactgcgaccttgattagttaatctcgacgtctagtgccgggcccgaggttgctctgaacgcccctgatatcacccttgctgccctggcctgtaggctctctagctttgctagagtatgtttggtatagggagctccgcatgttcgctagttactgttggaccatgccgagcaagcatacatgatttggggtatcaccacgcttctatatgccttccttaagtctttactaattctccagtgcccctcgtgggcgctggtggccaaccccggcgaacgatagttacctggttgattctgccagtaggcatatgcttgtctcaaagattaagccatgcatgtctaagtataagcaattatacggcgaaactgcgaatggctcattatggctcatgggagggcgtcccgcgggcgctgcagggtatgtaaaatcaaaaaagttgttaagagccgcggtaaattattggtttagagggtgggaagcgctgtaagtcgaggacagtggctagatacagggagggccggtctactgagcgtgagctacaggctgcagcgccttaggctttcgccttcagcactcgcgcccctctctcataggtgcaccgacccacatttaccctcgtgcacgccacatctaaatgccattcttgaagctggctgtagaatgtacgtattgataccgttggaagacaccgttgctgaaggcagtcattaatatcagtgtgaatagcttcaattgtatcaccttgaagatatcgctccgatcatttggctaccttaagagagtcatagttactcccgccgtttacccgcgcttggtcgaatggcttcgctttgacattcacactccccagaccaggcatcctcagtacgacgtaccgcacgcggccgctttcgtgagggtcgacgcccactatgaatcacccgcctccggccccgtatgctcttactcaaatccatccgagaacatcaggatcggtcggagatgcgccgaagctctctcctacgttatctagccactgtcctcgacttacagcgcttcccaccctctaaaacaataatttaccgcggctcttaacaactttttttattttacataccctgcagcgcccgcgggactggctcattatataagttatcgtttatttgatagtaccttactacttggataaccgtggtaattctagagctaatacattcttaaaatcccgacttcgggatctatgacaggatagagagagatgaaccatcggcatgggaagaaacgcgaacagcgcatattgtgcccccggcagagcgtggaattaaagctgaaggaactattcaagatctaagacctagtctagggtaggctggttatagggtagactgggtataggttaggtcgtctgagaatatcctaggatttttcccggatttattagacccttatctgggcttgataagcactttgaaaaaattagagtgctccaggcaggcctttgctcgaatacattagcatggaataataaaataggacgtgtggtgctattttgttggtttctaggaccgccgtaatgattaatagggacagtcgggggcatcagtattcaattgtcagaggtgaaaaatccgcgggaaggaataattctcacgccaggtcgtactcataaccgcagcaggtctccaaggtgaacagcctctgggtgatagaacaatgtagataagggaagtcggcaaaatagatccgtaacttcgggataaggattggctctaagggttgggtgtagtaagctattaaaagcttatattttatatctatttatactataagtaattactaaaacttagagataaatattatttactttcaacaacggatctcttggttctggcatcgatgaagaacgcagcgaaatgcgataagtaatgtgaattgcagaatgcagtgaatcatcgaatctttgaacgcacattgcgcccgccagtattctggcgggcatgcctgtctgagcgtcatttcaaacatcatttgcataatattaacaggaattatagtttattctataagttattatgttaatataaatttcgattatagttagagtatactgctcataacagtacttgtaagtgttcaattcactttatccctaagtctaagtgatgaaattggtaaaccggggctctctggtgattcatgataacttctcgaatcgcatggccttgcgccggcgatggttcattcaaatttcttccctcatgcacctcactgggaatgccaccaaagcatattcacacacaacacacgccacctaacctatactttacataacctatcctcaacataacctacactttacataacctatactcaacataacctacactttacataacctgcacctcacatgacctacatgcgacatggctacatgtcacgtgggatacccatttctctccgccaatcacactctgtccacccataaggtcgacaggggcaccagcatttgacctcagtaggaggggaacatcaccaacagcgagaacgaaatttttgaaaggacagcctcttgcagcacatcaaacctgtctcaaagggtcattgctcatgggagggcgtcccgcgggcgctgcagggtatgtaaaatcaaaaaagttgttaagagccgcggtaaattattgtgttagagggtgggaagcgctgtaagtcgaggacagtggctagatacagggagggccggtctactgagcgtgagctacaggtgaaataccactactcctattgtttttttacttattcaatgaagcggggctggatttacgtccaacttctggttttaaggggaaaagcttatacgctttcctcttaaaccagctaacagtaagtagcctacctagcttcctagcctggtggaattccttcatgagagcttcttcaagcaacggcctaataaaacccttaaagtaataataactattatctaaggtaatctaatatagctatttactaactatatttattatatactcctctagttcacgttcaattaagcaacaagagcttcttacatatttaaagtttgagaatggatgaaggcaatatatagcccccgggtccaatcacacgatagccgcggctatgattcaacagacctagaaggatcagtttcaccgagaggggtcaattagctaggtttgaggtttacaacctaactggacccgatcgtcagagccctgacctatcggctcgagcaaccctagccggtaggattgatcgcgaatttataagacccacttttatctgaaagaggctcttaagctgatcagttgagtatagatattagatatcttatctttaaaactgaaggaattatctaagatctaagacctagtctagggtaggctggttgtagggtagcttggtataggttaggtcgtctgaaggcctatggtaaagaaattgaagggataatgagagcggggattacacacataacgaaggcggacttcctacccgcggttttcaccgcatttaaagctgcaataacggaacaaaatatccagggcgcttttagaggtgcaggccttattccatttgacccaaaaagcgtcttgtcacggctagtcccaaactactcgactcgtcgaaggagtttcacagaggctaggcatccaaccgtacggggctctcaccctctatggcggcccgttccagggaactcggaaggcacgtcgccagaaacatcctctacaaattacaactcgggcttgcgccagatttcaatgacgctttgccaaatgacgctttgccaaatgacgctttgccaaatgacgctttgccaaatgacgctttgccaaatgacgctttgcgagtggtcacttggacaggctagacggcttcggcttcgctggcgggtgattcatagtgggcgtcgaccctcacgaaagctctgagtggtcacttggacaggctagacggcttcggcttcgctggcgggtgattcatagtgggcgtcgaccctcacgaaaccgcgccggtcgccgatgcgcctgcaaacgcgcctactgagattgtaaagattgtaaagattgtaaagattgtaaagattgtctactaatattgggaaggcctccggggaccaataggtacgcacctgggtgcgcacgtaagtgtcacgtgttgcgcacccggtgcgcgtgtaaggaagttatccgtacgccggacggccgaagcctgctaagggcatcagcacccaggtgctggctgccgccggccggttgcccggctagtggctggtctcgtcaaagttgtataggtcctcatctaggatgccgtattttgccttcaggttgcgtacgagagtaaaccaaggtctaataaagaagttggacgtaaatccagccccgcttcattgaataagtaaaaaaacaataggagtagtggtatttcaccggcgccgcagctcccacctattctacacctcctatgtcttttcacaatgtcaaactagagtcaagctcaacagggtcttctttccccctggcccgggaactgaccgtggcgtgcaagagggtaaatgtgggccggtgtatttctgaagagtacccaggctcatgggcgggcggtgagtcgatttttttgatttcccatacaaatgaattttgcggaaaatcaaaactggcccgggaactgaccgtggcgtggaagagggtaaatgtgggccggtgtatttctgaagagtacccaggctcatgggagggcgtcccgcgggcgctgcagggtagccggcgttgctctatgactttgcatattatgtatgctagatggcagtatacccctggttgctatcgcagcgtaggtcggcggcatcgctacctgcccattctgccccgcgctcctcagctcccgaaccataccgaccgcggtcttgcttaccacttcaaaaaaagtcatgtatatcggtcgcgcggtttggtggccgtgagtcgatttttttgatttcccatacaaatgaaccacttcaaaaaaagtcatgtatatcggtcgcgcggtttggtggccgtgagtcgatttttttgatttcccatacaaattaattttgcggaaaatcaaaagtggcccgggaaccacttcaaaaaaagtcatgtatatcggtcgcgcggtttggtggccgtgagtcgatttttttgatttcccatacaaataaattttgcggaaaaggggaaatgcacgtgtagatagctcaattacgtacgagacaatagcctcctcttcagattttataagattcattgaattggctcgagtatcactttggttagtattgtctcatgacttgagactcattagtttggatggcttctgtctgttaatatagcagcacagtgggtcactagatgaaactttgagggttccatgtgaaatttcactttggttagtattgtctcatgacttgagactcattagtttggatggcttctgtctgttaatatagcagcacagtgggccactagatgaaactttgagggttccatgtgaaatttccagtagccagtaagctacctgtagcatggatcttcccctacctccggagccaacaggcacagccactcgatggccaccccaaccacaggccgagagaatcaatattgccaccggaaatcgatcgactttggacccaccgcgacaatcaagggctggacggagcaagtcgccggccaagagagcccagaagagagtcaacttagacgatcagataccgtcgtagtcttaaccataaactatgccgactagggatcggacgatgttaaaaattgactcgttctgcaccttacgagaaatcaaagtgcttggtacagtggccttcaaggtgtattgggccttgaggccgctataacgcagcaggaagttcgctataacttacagtctcttaactgctaactccgctattactcagtgagttttagtgccgggaaaaatcctaggatattctcagacgatctaacctatacccagtctaccctataaccagcctaccctagactaggccttagatcttgaatagttccttcagctttacaccaccacaaatccaaccacagcgaatgcacgccactgtaaattccaccacagcgtgcatgcaccaccacaaatccaagtatattagagtttattttagtttaatttaaaattatatttatttagaaataagaaaaattagttatataaaattattaattaatttatctctataagtataatatatatttattactatagaaggtttttattaggaataatatagatttaatattaatctaatatttatttatatatagttatttatactatatgcaatgctctatccccagcacgacggagtttaacaagattacccaggcctttcggccaagggagtactcgctggctccggcagtgtagcgcgcgtgcggcccagaacatctaagggcatcacagacctgttattgcctcaaacttccatcggcttgagcctttagacctcttgaacgttgtcttccttttctattctatacttcggcaggtaacggaacgcttcgttagtgctcctttacagagcacggttccattctcaagttaaaagcctaccccgatcattgatctaccgtttcgtgccgaagccctttcgtctctggctgaagagcactatctggcaacttacaaacggtgccgttagcggtgggaacgactgtacgtgtatgatgtagaccttggtatcagtccaacggcttgacaacgccgaggtatagggtaactcgctctgcagcaagcctcaaaccttgcctctatagaggttaaaattgctggcatcgatgaagaacgcagcgaaatgcgataagtaatgtgaattgcagaattcagtgaatcatcgaatctttgaacgaacattgcgcccgccagtattctggacttaaacggtcatggttggctgatcttacgagttgatgccctaagtactaatacgagaacgaaggcaataatggacgtgagtggagcctatccacaatggccgcacatctccttctccagtatcttaggcgatatagccttcagggtagcttagaagagatgggatggcgggtttacaagagtcatgtatatcggtcgcgcggtttggtggccgtgagtcgatttttttgatttcccatacaaatgaattttgcggaaaccaataccctgttctttattgaagtgatcaccgatgtatactgacaaccattggatcccactagctaaaacagataatcatatctgttgtcaatgcgagagcaggtgcattttacgttaacgatatcgccctgctccaagtcgagattcgagctggcgcggctaaacttaccactgagcaacgggagatcgccacgtgcagcggacaccgccatggttgaagctgtgcgctgagcactgctcttggggcgcccaagccgcaccggccctagtggtcttggtgtggtggaaggatgccctggggaactgagagggggaagtgaaattcttggatttattgaagactaactactgcgaaagcatttgccaaggatgttttcattaatcaggaacgaaaggtaggggatcgaagacgatcagataccgtcgtagtcttaaccataaactatgccgactagggatcggacgatgttaaaaagacccgtcttgaaacacggaccaaggagtcgtcttcgtatgcgagtgttcgggtgtcaaacccctacgcgtaatgaaagtgcttcagaaatacaccggcccacatttaccctcttgcacgccacggtcagttcccgggccagttttgattttccgcaaaagtcatttgtatgggaaatcaaaaaaataagggaacgggcttggcagaatcagcggggaaagaagaccctgttgagcttgactctagtttgacattgtgaaaagacagaggaggtgtagaattctgacaagatgcgaacgttcgattcattgctggtctgattaagatcgcgaaccagcattgtcatgagaagccgaaataactggtgctcaattggtttatcagcataagaggagtgctcagcgcacagcttcaaccatggcggtgtccgctgcacgtggcgatctcccgttgctcagtggtaagttaagaggagtgctcagcgcacagcttcaaccatggcggtgtccgctgcacgtggcgatctcccgttgctcagtggtaagtgtagccagcggccatccatccacagaacccatccagcgccggcgagagcagagctctccccagaccaggcatcctcagtacacatttcgattctaactatacacttagaaggttgctggtggttagccagcagttcagatttcaagcatcagctatgtttgctgctagatctaccaataatttagaaagaaaagattcatcgtggtaaggtgctggatatagtatcttcactgctgtattatataatataaataactatatataaatagatattagattaatattaaatctatattattcctaataaaaaccttctataaccagcaatatcagcacatgacttctcacggccgtaacgatcagtgcgtactttcgaaaggatcgctttagcagcttctagcgaggctacaggtggtctgccggagcgagcagcatcctcaaagtaggagtctttgatcgtcagctggcttgcatttggaagtgaccactcagtgggaatctgcaagatacggtacagttgaagagatttcccacagcggatcggaccagcttgttacagtcgtgagacaggttagttttaccctactgatgacctcgccgcaatggtaattgagcttagtacgagaggaaccgctcatgcagataattggtctgagcgtcatttcaaccctcatgcccctagggcgtggtgttggggatcggccaaagcccgcgagggacggccggcccccaaatcgggaaactgcccctgccgagccatccaccactcaattggatcctcggtttcctgtggctccaaccgcagataccgctcgacgtcgctatgaacgcttggccgccacaagccagttatccctgtggtaacttttctggcacctctagcttcacacgtcgaacaccttctttcgggtccggccccgtatgctcttactcaaatccatccgagaacatcaggatcggtcggagatgcgccgacgctctctcctacgtgatcgaggacctcgtcaatctcgctcagagtcacattcggaccgagcctgggttcgcagtctgttataaccatcacacgctcaacgcaagacgcaaagtctggaccgtcattggctttccacctctgtagctcgctcattcgagatgacccaaggcatcgtcgctactaccgattgaatggctcagtgaggcgtccggactggcccagagaggagggaaaccaccactcagggccgggaagctctccaaactcggtcatttagaggaagtaaaagtcgtaacaaggtctccgttggtgaaccagcggagggatcattgaatggatgaaggcaatatatagcccccgggtccctaatcattcgctttacctcataaaactgagttcaatactgctatcgaatggatgaaggcaatatatagcccccgggtccctaatcattcgctttacctcataaaactgagttcaatactgctatactgagggaaacttcggcggaaaccagcaggtctccaaggtgaacagcctctggttgatagaacaatgtagataagggaagtcggcaaaatagatccgtaactgcgggataaggattggctctaagggttgggtacgttgggctttgggaggacgcctcgggagcaggcagccactagccgggctgtccctccggccgttgaacgagactcaatgtgtggactgcgatgtcactaacggagcgagattcaatatcgggtgttgctttttcggcagtacggatcgcgtggcaagtagaatcggtacaacgtgacgcagttcgcgaggcaggcgaggattataggcctgaagacgaggttgtgcgctgagcactcctcttggggcgcccaagccgcaccggccctagtggtcttggtgtggtggaaggatgccctgggggactgagagggggaaggtggattgccgtgcgcggcgtcggtggccctgccgctggtgctgtgttcggcgcgctctcacgagtgcgctgagcactcctcttggggcgcccaagccgcaccggccctagtggtcttggtgtggtggaaggatgccctggggcactgagagggggaaggtggattgccgtgcgcggcgtcggtggccctgccgctggtgctgtgttcggcgcgctctcacgaataaggagactagcgtaaatgtagcttgtgaaaaatcacgcaggtctacaaagaggaaacgcaaggatgaaccggatactggaggtatggtaacccaggtgcttacgagggtaaatgtgggtcggtgcacctatgagagaggggcgcgagtgctgaaggcgaaagcctaaggcgctgcagcaagccactcacagcgtctcgggtcaactgtaacaagctggtccgatccgctgtgggaaatctcttcaactgtaccgtatcttagcgacgaagcgggctatttgaatcggggtcgagccggacgaatacatcgcgatgattttatcttcgtatcgcaaaatcgtctcttgtttgggagttgtaaactcggtaatgatccctccgctggttcaccaacggagaccttgttacgacttttacttcctctaaaatcaaccagaggctgttcaccttggagacctgctgcggttatgagtacgacctggcgtgagaattattccttcccgcggcttttcaagggacgtcgagagcgcaccagacccagcagaggtgctgggctcttccggccattaaaccctagctccggacaatcaaccagaggctgttcaccttggagacctgctgcggttatgagtacgacctggcgtgagaattattccttcccgcgggttttcaagggacgtcgagagcgcaccagacccagcagaggtgctgggctcttccggccattaaaccctagctccggacataagctttaagttagaaaggaaaggtagttattactattagataataagcttcccctcttaggggctatagctatagccaggttatttatatatctagctgtataaatagctcctattattagagtttttaaggtattaatatctatacccaggctgactatcgcgaggagcttgcgaagaaggatattctaattgattcatcaccaatcagcaagatgaccttccttcagtgttatgcaaaggctcgattgatcggtctaacagatacgaatattcgctcggctgaatgtcaaagcgaagccattcgaccaagcgcgggtaaacggcgggagtaactatgactctcttaaggtagccaaatgctgaatgtcaaagcgaagccattcgaccaagcgcgggtaaacggcgggagtaactatgactctcttaaggtagccaaataatctcaaggaggaagccccacgctaaagaccgccaaggtcccttacgaatacggtgatccaatccctcttgagcccttaattggtcacctctatctactgctcccatatgatcgttataagcagcagatacggaccggataggtgcctctttcaccggcatctcaaggaggaagccccacgctaaagaccgccaaggtcccttacgaatacggtgatccaatccctcttgagcccttagttggtcacctctatctactgctccggctccttcggtgcctaggctccctttatcaccgccattcattgcttcttgccggccctgagcaagacccgtcaccaagtgcgactccgatgccgactttggttccagctctagtcttgtagctagtctaggggacgacggggactattgcccctctctattgccttcatccattctcaaactttaaatatgtaagaagctcttgttgcttaattgaacgtgagcattcgaatgtataaatactagtgggccatttttggtaagcagaactggcgatgcgggatgaaccgaacgcgaggttaaggtgccagagtagaaaatagatataaaatataagcttttaatagcttactatctataaagtaatagttaaatagaatatttaaattaaactctggaataattggtggcattcccagtgaggtgcatgtgctgaagtttggttcccggcgatgtgcatgtgctgtggttggatttgtggtggtgccaccaactaagaacggccatgcaccaccacccacaaaatcaagaaagagctctcaatctgtcaatcctcattgtgtctagacctggtgctagcttcacacgtcgaaggactaaaggatcgataggccacactttcatggtttgtattcacactgaaaatcaaaatcacggggacttttacccttttgttctactggagatttctgttctccatgagccccccttaggacacctgcgttatggtttaatagttattagttctttagattttaatagtttaataatataattaaaagatattaattactatagttattctaatattaagattagtttaaattctctatatagtttatattatatagatttaatttatatatatatattatattctaaaactatagtttataaaagtcatgtatatcggtcgcgcggtttggtggccgtgagtcgatttttttgatttcccatacaaatgaattttgcggcaaatcaaaaactagatttaggggccggccgtccctcgcgggctttggccgatccccaacaccacgccctaggggcatgagggttgaaaggacgctcagacaggcatgcccgccagaatactggcgggcgcaatgtgcgttcaaagattcgatgattcactgaattctgagagataaaagctcttctgtagctaaaggaataaattataaggctaataaagctaaagaagaagctaataaagctaaagaagaagctaataaagctaaagctaagcctaaagatcctaaagataactcttctaattataagaagagataaaagctcttctgtagctaaaggaataaattataaggctaataaagctaaagaagaagctaataaagctaaagctaagcctaaagatcctaaagataactcttctaattataagagattcatagtgggcgtcgaccctcacgaaagcggccgcgtgcggtacgtcgtactgaggatgcctggtctggggagagcgctgctctcgccggcgctggatgggttctgtggatggatggccgctggctaaacttaccactgagcaacgggagatcgccacatccaaggaaggcagcaggcgcgcaaattacccaatcccgactcggggaggtagtgacaataaatactgatacagggttctacatccaaggaaggcagcaggcgcgcaaattacccaatcccgactcggggaggtagtgacaataaatactgatacaggggtcttttggatcttgtaattggaatgagtacaatttaaatcccttaacgaggaacaattggagggcaagtctggtgccagcgccgttactagggcaatccctgttggtttcttttcctccgcttattgatatgcttaagttcagcgggtattcctaccttatctgaggtcaaccttggaaagttgggggtttaacggcaggggctcgtcgctctccgatgcggaatatcactacttcgccggacagccgcaaaaaccaattatctgaatgagcggttcctctcgtactaagctcaattaccattgcggcgaggtcatcagtagggacgcttaccgaattctgcttcggtatgataggaagagccgacatcgaaggatcaaaaagcgacgtcgctatgaacgcttcgccgccacaagccagttatccctgtggtaacttttctggcacctctagcttcacacgtcgaaggactaaaggatcgatacttgactctagtttgacattgtgaaaagacataggaggtgtagaataggtgggagcttcggcgccggtgaaataccactgctcctattgtttttttacttattcaatgaagcggggctggatttacgtccaacttctggttttaaggtccttcgcgggccacggaccaaggagtcgtcttcgtatgcgagtgttcgggtgtcaaacccctacgcgtaatgaaagtgaacgtaggagagggcttcggcgcatcctggggcccccgccgtcgtctccgcgttcagttgcgttgccgcgcaaaacccacatccaggtgccggaatattgaccggcttcctcggtcgcgcggtttggtggccgtgagtcgatttttttgatttcccatacaaatgaattttgcggaaaatcaaaagtggcgagctgcgaaggctcgtacggctatatgccttccttctctcatccacttagtgactccgttggtagtcactttcgcattgacacggcccagttcgttcatacaaacccccatcatgagtaaggacacatttgaccacaaatccaaccacagcacatgcacatcgccgggaaccaaacttcagcacatgcacctcactgggaatgccaccaacgcatattcacacacaacacacgccacctaacctatactttacataacctatactcaacataacctacactttacataaccagctttaaagataagatatctaatatctatactcaactgatcagcttaagagcctctttcagataaaagtgggtcttaaaaaggctatatatatcggcggccctcgtcaccgtagccaaagtggcactcgtccgagaagatcacatcatgccaatcctcagggttaggccgagctaagagggcttccgtagcccaattaaatcgctgcttggccgaggcctcggtggtgaaggcaacctctgcagctagccgctatgcctagacttcgaaacctcatacaggaggatcgtgtgaagagaatataacgaggccaaagctggcgtccccgagggtaatggttgtcgcaacaacagcaacagcagcaacaacagcaacagcagcaacaacagcaacagcagcaacaacagcaacagcagcaacaacagcaacttcgatgattcactgaattctgcaattcacattacttatcgcatttcgctgcgttcttcatcgatgccagaaccaagagattggtgagtttccccgtgttgagtcaaattaagccgcaggctccacccctggtggtgcccttccgtcaatttctttaagtgtcagccttgcgaccatactccccctggagcccaagcactttgatttctcgtaaggtgccgaacgagtcaatttttaacatatagaaggtttttattaggaataatatagatttaatattaatctaatatttatttatatatagttatttatactatataataactccctagttttattattattattattattattattattattattattattattattattattattattattattattattattattatgaagggatgtatttattagattaaaaaccaatgcccttcggggctctctggtgattcatgataacttctcgaatcgcattgccttgcgccggcgatggttcattcaaatttcttccctatcaactttcgatgtttgggtattggccaaacatggttgcactgaatctcctctgaacgcgtcttcgttctcttcgataaggccgtctgagttagggggcggggtttcctcagaccctcccatcgcgaagagagtcagggcgaccatcttgggctgggaagtgtttgttcaaatggttgcagtgagttttttctttgtgaatgatagtgcggtcatctattagtgagctacgcttaatgaccacacaaaaatcagccaagcccacaatattaaaccgcgtcaaagccagtctgtttacttctcccccggtgcggcttgggcgccccaagaggagtgctcagcgcacagcttcaaccatggcggtgtccgctgcacgtggcgatcccccgttgctcagtggtaagttttattccgcaaatgctccctgctcttgtagattgcccgggaggaatcctcccactctatctcctggctggaatcgagtggcctgaggagtttttagtcggtagatctatgagagaaattagtataattttctgatctctctcacaaaaataagattcttttgcgctatattttgcactatattacgcaaacttgaaagggaaaaatctttattcaccgcccttttagccattgaatgatcccaatgtgaaacattttggggttatagggtatgccccagagccaaatcctacaccgcagtagcttgctttgttcctcaaacgttacatacacgtcggccaatagcggaagttccgttcccacccttgccacccaatctcgatcggtgtcgaatattgaagttccagaggagggcgaggcaggttggcgattcccgtccacagaacatggccaagctattagacggcctagcgccagggcaccagcggcagggccaccgacgccgcgcacggcaatccaccttccccctctcagttccccagggcatccttccaccacgaggcgtccggactggcccagagaggagggaaaccaccactcagggccggaaagctctccaaactcggtcatttagagggaggttggatttgtggtggtgcatgcacgctgtggtggaatttacagtggcgtgcattcgctgtggttggatttgtggtggggtgggtgcgctgtggttgattatgtagtgggttgggtgcgctggggttggaattttagcggggtgatacacgctatggcgttggtttctaggaccgccgtaatgattaatagggacagtcgggggcatcagtattcaattgtcagaggtgaaattcttggatggcacttcgacagctgatcaacatcatgaggtggtctagcccctgaactccgatggaggagcagttgaggctatgcaactattcccattacttgcaggatgtcaaactcgggcgtgccacacggcaccatcactatccaatggtatcgctgaattagaaactgcatggccttgcgccggcgatggttcattcaaatttcttccctatcaactttcgatgtttgggtattggccaaacatgggtgcaacgggtaacggagggttagggctcgaccccggagaaggagcctgagaaacggctactacatccaaggaaggcagctagaccgtcgtgagacaggttagttttaccctactgatgacctcgccgcaatggtaattgagcttagtacgagaggaaccgcccttgcagagcgcgaacctcagtccaccccagggtattacacagtgggctataacactcccgagggagccacattcccaatctcggctgcgaagatatccgctcatgcttcccggccgccaacctccttttttaattttattatcccacttagtaataataccgtgaaagggaactatagtttagtattttaagacgaatataagctatagtatatagtacttatttatcttttatatatagcctcactagatatatataacctataaccttgtgtgtatatcggtcgcgcggtttggtggccgtgagtcgatttttttgatttcccatacaaatgaattttgcggaaaatcaacatgtatatcggtcgcgcggtttggtggccgtgagtcgatttttttgatttcccatacaaatgaattttgcggaaaatcaagtgtatgatatctcaacaagagcatatatcgtggcgttgaaagccacgagccggcttagcagtcgggaaatctcttctttgaccggggttccaacccgtacaatcgaccggatctatgccaaagcctctaaatgaccgagtttggagagctttccggccctgagtggtggtttccctcctctctgggccagtccggacgcctcacaggcggacgtggaggtcagtgacgaagcctagggcgtgagcccgggttgaacggcctctagtgcagatcttggtggtaggagcaaatacttcaatgagaacttgaaggaccgaagtggggaaaggttccatgtgaacagcggttggacgtgggttagtcggacggaaatgtgagaacaagcctcggggttagcagtgtaagctcagggcataccgtttgaagtacacagggtgctcgtcatggtgatcgtcgctgataaatccttgaaaaatcgggatgcccttagatgttctgggccgcacgcgcgctacactgacggagccagcgagtactcccttggccgaaaggcctggggaatcttgttaaactccgtcgtgctggggatagagcattgcaattattgctcttcaacgaggaatccctagtaagcgcaagctgggcatcacgatggagggggcacagactgagtctgtttggggggtaatggacatcgtccccgttacagacttccgtgagcatcctatacaaatctctcttgtcacgaacactggatattgctgactgatctggctcgagcagcggatattagaagtcgttgtacaattcacagcgcgtcagcggcttggtcagagtatccgaaggtgtaaaacagatacttgaggcgttgaacgagctcgtctgtagctactagagcgtggtgtcgtacatctaaatgccattcttgaagctggctgtagaatgtacgtattgataccgttggaagacaccgttgctgaaggcagtgatcaacatacaaccaaacacatgatgcaagcactcggctgctcattagagggacaaactgaagctacaatgaaaaaaaggatcccaaatgcaactgcgttgggcaatttaccatgatagcttcatgatgacgcagcttcctttatctttacatcctcccggttccagggcaagatcgtccgacgcaacaacccacagaggtcaaaaatgatatagcctatcctcctcgcaataaaggtggcgtgtacaaataagtcttgcctgattcttgcaccaggcatttgaaaatgacccggcagtcatcatccgcatttctcgcttaagcaatttttatttttgttataaaaagtgacaaaccacgcccaataaagaccgcatgctgtaccaaatcacgcaaaagacattgctcgatccaatgcatcgtctggaagatgcggacaatcatcgaggaacataatgagattttcttttggatcccacgacaactactccatgacgtgaggcgtcgagtggcagcagtgggatggagacaggatctacttctcaagctctcaactcaagctcctaactcgttccgaaaaggcattggcgggccctggaggggaccggtctcctgtgcttcgttccttcccctcctcccttcaaccgtctgcgccacaacacgtgcgccacggtttgcgccactaaaacaataatttaccgcggctcttaacaacttttttgattttacataccctgcagcgcccgcgggacgccctcccatgtaaaacaataatttaccgcggctcttaacaacttttttgattttacataccctgcagcgcccgcgggacgccctcccatcaagaccctgttgagcttgactctagtttgacattgtgaaaagacataggaggtgtagaataggtgggagcttcggcgccgatgaaataccactactcctattgtttttttacttattcaatgaagcggggctggatttacgtccaacttctggttttaagaatactaaaactaatttaagttctctatatagtttatattatatagatttaatttatatatatatattatatttagaaattataatctatacttctttttatagatttagataattataatactatttaattctattaaatatttttttaactccttagtattctaagagtaaatatttatagatttctttaataaatactattcttatttcctattatagcttttttaagctagagatagtttctatctagactttagtatatattatctctctaaatatagttcttaaggttttttatattaaatattctttattattaattaaaaatagctatttatttattcttagaactatttctttatatttagatttataattaaaagtattagtttttctattttctaatcccttctaatatataattttataattaaattaagataaatatttagtattatatatttatttcctatttagttattaaattattataaaatactaaatattcttataatctatatatactttaatcttatataatattcctaagtagtaatatttaaattctttaaatatatatataataactataaattccttattataaatagaataattaagttctatactatataagacgctgcaatgaatacacttacagctctcttccaagaatcctccgcagcaacattggcctgtatctggtaggcctgcctgtcgttgaagccatcaaccagaccgtctttagcctgtagatcaaggcctaagaccatagcaccttcacgaataaaggtatggaataataaaataggacgtgtggttctattttgttggtttctaggaccgccgtaatgattaatagggacagtcgggtgcatcagtattcaattgtcagaggtgaaattcttggatttattgaagactaactactgcgaaagcatttgccaaggatgtgagagaagggatcacaatatgagaaaaccactagagataaaccactagagattattcaagctgactgtgatatattagcatcatatgccttgaccttggctgacagtaacgtagaactgccttgttggcatgccaaaggcatagaagcgacactgcagctgggaagcaatgagatactgcattcatgcaggcgagacagcggtctgtaaggatcacagatggcatccttgcgcggtcgcgcggtttggtggccgtgagtcgatttttttgatttcccatacaaatgaattttgcggaaaatcaaaactggcgcgggaactgaccgtggcgtgcaagagggtaaatgtgggccggtgtatttctgaagagtacccaggctcatgggagggcggcacacccagacactctcaccatgatcatgcaagcacccggccagttacagggcacctaccctactaaaacaacccacaccagtatacataagcaactggaagtcagccatagcgtgtatcaccccgctaaaattccaaccccagcgcacccaacccacttttatgaggtaaagcgaatgattaggcacccgggggctatatattgccttcatccattctcaaactttaaatatgtaagaagctcttgttgcttaattgaacgtgaatagttgacctatcagcatgggatagctgacggtgaactggatgtgcagatagatttgtgcttggctcgtggttatgatgggcaaactctctgccgggacggtgtgcaagacagagatgggatggcgggtttacaaaagtcatgtatatcggtcgcgcggtttggtggccgtgagtcgatttttttgatttgccatacaaatgaattttgcggaaaatcaaaaagagatgggatggcgggtttacaaaagtcatgtatatcggtcgcgcggtttggtggccgtgagtcgatttttttgattttccatctgagggtaagccgtccttcgcctcgatttccccaatacaggcggccctggtggctggctgcgtagggggtttgggagagggattacaaggacgccagagttctggcgcccggtctgtctctcgggaagcggctgcagggtagccagtctatctttacagagtttaacaagattacccaggcctttcggccaagggagtactcgctggctccgtcagtgtagcgcgcgtgcggcccagaatctcgtcaaagttgtataggtcctcatctaggataccgtattttgccttcagattgcgtacgagagtaaaccaaggtccgataacctttggatcttcgcatttagccctctgatagtcatatttccgaacccccgcaaaattcagttgtatgggaaatcaaaaaaatcgactcacggccaccaaaccgcgcgaccgatatacatgacttttgtaaacccgccattgctcttactcaaatccatccgagaacatcaggatcggtcggagatgcgccgaagctctctcctacgttcactttcattacgcgtcgagcggtatctgcggttggagccacaggaaaccgaggatccaattgagtggtggatggctcggcaggggcagtttccaatggtcagccagttggctcttgatatacttgccataccggcgatggcgactgattgtgagaggtcgttcagcctggccaacgttccgctcaacctctgagcttctcgagctttatatatatcactaggaaatctaatttccttatttttattttttttaatactactataaaataagtactaaaataatcttttatttaattgtaacatctaaatagaatttaataggaccgggaaaaatcctaggatattctcagacgatctaacctataaccagcctaccctagactaggtcttagatcttgaatagttccttcagctttaaagataagatattcaatatctggctgcagaggcaaaggccgcaaaggctgcagaggcaaaggccgcaaaggctgcagaggcaaaggccgcaaaggctgcagaggcaaaggccgcaaaggctactaaaaccttcaaccgatatatatagcttttataagacccacttttatctgaaagaggctcttaagctgatcagttaagtatagatattagtccttatcccgaagttacggatctattttgccgacttcccttatctacattgttctatcaaccagaggctgttcacctttgagacctgctgcggttatgagtacgacctggcgtgagaattagacggccgaagcctgctaagggcatcagcacccaggtgctggctgccgccggccggttgcccggctagtggctgcctgctcgacggccgaagcctgctaagggcatcagcacccaggtgctggctgccgccggccggttgcccggctagtggctgcctgcgcccgaggcgtcctcccaaagcccaacgtacccaacccttagagccaatccttatcccgaagttacggatctattttgccgcaataatgaaccatccggctatcaaacacatctctccgagagaccgttggaatatggatgaagccggcattatggagggagtcagaggtaacgggctggtactaggatcgccccaagaggagtgctcagcgcacagcttcaaccatggcggtgtccgctgcacgtggcgatctcccgttgctcagtgggaagtttagccagcggccatccatccacagaacccatccagcgccggcgagagcagagctctccccagaccaggcatcctggccagtatttcaaagagctcgcgaagctgattattctgaccaccacttcaaaaaaagtcatgtatatcggtcgcgcgggttggtggccgtgagtcgatttttttgatttcccatacaaatgaattttgcggtatattcagctatgttgcctgatattgttggtccaggggatatctttatgcatgataatgccccttctcatacagcctacatcgtaagagctcggtcttctttccccgctgattctgccaagcccgttcccttggctgtggtttcgctagatagtagatagggacagtgggagtctcgttaatccattcatgccgtgagtcgatttttttgatttcccatacaaatgaattttgcggaaaatcaaaactggcccgggaactgaccgtggcgggcaagagggtaaatgtgggccggtgtatttctgaagagtacccaggctcatgggagggcgtcccgcgggcgctgcagggtggacgacgtgcttgcccgtaactatgatacggagattcagattccgctgctgcatcgaagttcagacaccgacgcacagggtcctagacggctaggctatcacttccaaccaggtatatctcttgctcgggatcttaatttatatgggaaatcacactgaaaagcgtgtccgagaccattggaataggatcagaacgctcttcgaggcatcggctccgcgccgatctctcggtattggattgatcgtcaggtcagtaggttcgcgatcaatcctaccggctagggttgctcgagcgcacaactcgcccaagcgtcaccgccagattttccccgctgtgacacccgagctggcgtcgaagtgctagtagacgcggctggtgcttgcctacgcggtcaagaaaatgagctgtaaccgccatgacagcgtgccgattgggtgaagtccataggtcgcctattaaattctatttagatgttacaattaaataaaagattattttagtacttattttatagtagtattaaaaaaaaaataaaaataaggaaattagatttcctagtgatatatataaagctcgagaagctcagaggttgagcggaacgtcttaaaaaatatatattagattatatattatctaatcttagaatatatctttatttatagtaaaactaatagaaaatataataagtctatttttataatattttaattaatttaataatagttataaatatagtatatactttattatatagtataaataactatatataaatagatatcaggttaatattaaatctatattattcctaataaaaacctcgtgcaaatcgatcgtcaaatatgggcatgggggcgaaagactaatcgaaccttctagtagctggtttccgccgaagttgccctcaggatagcagtattgaactcagttttatgaggtaaagcgaatgattagggacccgggggctatatattgccttccgggtttacaaaagtcatgtatatcggtcgcgcggtttggtggccgtgagtcgatttttttgatttcccatacaaatgacttttgcgggtcgcctccagcaggaagtgacacttgaaccagtcttggttcacgcatcaccgcgccaacatgtagagcttttcgactttcccaacaataacaatctaagcagcaactgtaatgctatctttggtctggttattgttcgagtatagagcttcttgctcgataatatctagctcgatgctcttccaaatcgcgttcatacctcttcgcctgtttgttagacggtctttccttatctcctcagcaatacgatctgctgagggtaagccgtccttcgcctcgatttccccaatacaggcggccctggtggctggctgcgtagggggcttgggagatggattacaaggacgccagagttctggcgcccggtctgtctctcgggaagcggctgcagggtagccagtcttttgacgatcgatttgcacgtcagaaccgctgcgagcctccaccagagtttcctctggcttcaccctatacaggcatagctcaccttctttcggtcggcatagtttatggttaagactacgacggtatctgatcgtcttcgatcccctaactttcgttcctgattaatgaaaacatagcctttatcccccggggcgaactgatgctggcctgggcaggcagagtgcaccgcggagaaccacggatgatcaacctgcgggcttcctccctgctagatagaggttctttaagccaccaattcactcttttatctaccctacagtctatctttcttagttaccctgtagctgataaagcctctctttcctactaagtaggctgcttcttccactacgcctttcgaaacgatcccttcatatacaactttgacgagaccggctttatgatgggggttatcttccctggaatggtggttactacctcagagggtcgtacaaaggctaagctagtggcttcgaatctatccactctatccaatccttgatcgcgagaggttcgaaagagattacgcggaaatctggacatcagatcactctccctcttccatgccaccacggcctgcttctgcgtgctcgccggattacaggtaccaatatcccaatcacgtgggacctggcgacaagatacccaaatcgcgccgttttcacattctactcaacatcatgttcgccctgggtcgtcaatgcgactcctcggagccatcggcccggcaggggcaaaggggagacattttttggaagcgaagcaaggaccttctcgagctagactttgatattttcaatcagccatgcatcgaatttatttcagtagaccggccctccctgtatctagccactgtcctcgacttacagcgcttcccaccctctaaaacaataatttaccgtcagtagaccggccctccctgtatctagccactgtcctcgacttacagcgcttcccaccctctaaaacaataatttaccccggctcttaacaacttttttgattttacataccctgcagcgcccgcgggacgccctcccatgagcctgggtactcttcacggagggttagggctcgaccccggagaaggagcctgagaaacggctactacatccaaggaaggcagcaggcgcgcaaattacgaagctaggtaggctacttactgttagctggttcaagaggaaagcgtacaagcttttcccgttgaaataccccaattgtgcagctatttttacattttctaatggatggtggactaactttaagctaccaaacccgccctttttcctgctacgcgtttttcctcctcttcaacaccgcactatcattcacaaagaaaaaaaaaaaaactcactgcaaccatttgaacaaacacttcccagcccaagatggtcgctctgactctcttcgcgatacagtgaagggcatagggttccacagagggaaaggcccggccggaccagtacacgcggtgaggcggaccggccagccaggcgacgttgatagggagcggcattgctaggcggggatccaccatcatacggtcggcatttgtaaagggatccgtgaacccatcattcgtatctcccccggtgcaatatccgttagcgtagacccatgagcaaacatctcacctcgtaaaattgaaccaatgaaaggcagcctgtcctcgcataggctgcgaaaaccccttttaatttccgcttatgcagttgaattttgtctaggacttacctatgagcagaaagtcctagcggtgatcccgagccgccaaactcattgaagtatttgctactaccaccaagatctgcactagaggccgttcaacccgggctcacgccctaggcttcgtcacttacctccacgtccgcctactcctcagggcatcgtttctaccctgagggcgaggtatgggtgagacgcttgagcgccatcctaggaccgccgtaatgattaatagggacagtcgggggcatcagtattcaattgtcagaggtgaaattcttggatttatttaagactaactacgtgttgagggtatagttctgcgcggaaactcgtcctagttccgtgaagctagatgtcttgtcaacatcgacgagcatccgaggaccctgtgcgtcggtgtctgaacttcgatgcctttttgatccttcgatgtcggctcttcctatcataccgaagcagaattcggtaagcgttggattgttcacccactaatcgggaacgtgagctgggtttagaccgtcgtgagacaggttagttttaccctactgatgacctcgccgcaatggtaattgatcgtcttcgtatgcgagtgttcgggtgtcaaacccctacgcgtaatgaaagtgaacgtaggagagagcttcggcgcatcgccgaccgatcctgatgttctcggatggatttgagtaagagcatacggggccggacccgaaagaaggtgaactatgcctgcatgcatggcttaatctttgagacaagcatatgactactggcagaatcaaccaggtaactatcgttcgccggggttggccgcatatctagattggaacaaagcagaagatgaacgtatagaggcccaggtcgctagagagatagaaagcaatccattcggtagtaggagacgaggtgtgcaagatatctggcgaaggatagaggaggatgtcaaggaacaggaagccttatacttaaggtagccaaatgcctcgtcatctaattagtgacgcgcatgaatggattaacgagattcccactgtccctatctactatctacctaggggcatgagggttgaaatgacgctcagacaggcatgcccgccagaatactggcgggcgcaatgtgcgttcaaagcttcgatgattcactgaattctgcaattcacattacttatcgcatttcgctgcgttcttcatcgatgccagaaccaagagtgtcagcggagctggcggaagagatggtggtgtgcggaatccacccggcggaccacgggtccgaccaccgggccatccggaccgtgtttgatgtggggacgccggaacgcaaagccagcccatgtactagccctgaaaatggctggcgctcaagcgtctcacccatacctcgccctcagggtagaaacgatgccctgaggagtaggcggacgtggaggtcagagtcatcagcttgcgttgattacgtccctgccctttgtacacaccgcccgtcgctactaccgattgaatggctcagtgatgcgtccggactggcccagagaggagggaaaccaccactcagggccggaaagctctccaaactcggtcatttagaggaagtggacaggctagacggcttcggcttcgctggcgggtgattcatagtgggcgtcgaccctcacgaaagcggccgcgtgcggtttttgattctccgcaaaattcatttgtatgggaaatcaaaaaaatcgactcacggccaccaaaccgcgcgaccgatatacatgactttctcaatttatcttcataggaacactcagtaaaaccacagtggtctgtgtggcatcaaacccatacgatagcgaaatatgcaacaagaatgtagatttaaaagcaggaaataacggaggtcggttgatgatgacgggatgtttactaactagtagacggtgccagaaaagttaccacagggataactggcttgtggcggccaagcgttcatagcgacgtcgctttttgatccttcgctgtcggctcttcctatatatatcttaaagttatttattttttagtatatgtttataaaaagtagtttattctattatgtatatattatataacagttattgttatataggaaagttgggggtttaacggcaggggctcgtcgctctccgatgcggaatatcactacttcgcagaggaggccacgacgggtcgcctcaaccatctgatatggggttgccgggggatctccccttcgtacaggatccacctggggcgggggcgtcaccaacgggtgatgaagtcgtccatcacgaacggccgaggcctgcttcacgtctcgaagaggaaccggtatagctgaaattcaacgatacagcttataataatgaggaattattcagatattggatagcaaatgaattagctgtaattctggatggtaaggaacacatgttggttatggatgtagccagcttccatacgactgacgacgtacttcaagacctacgatctcgtaagaaattcaacgatacagcttataataatgaggaattattcagatattggatagcaaatgaattagctgtaattctggatggcaaggaacacatgtgtgggttgttttagtagggtaggtgccctgtaactggccgggtgcttgcatgatcatggtgagagtgtctgggtgtgcgatgtagtacctttccattttctggtcgaaaattccaaaaagtgacaaaccacgcccaataaagaccgcatgctcgcaggttcgctcaacggtggcaggcttccccccttcatgatgccagcggcgaacgtcctgccacatcttgtcgtaaccatgcctccgtccgataattaccttggccaatctttcctcgatggagaacagctgcgagctatgatatctttcagtgagcgaaaagggagcagcacagagaccggggctcatggagaacagaaatctccagtagaacaaaagggtaaaagtccccttgattttgattttcagtgtgaatacaaacgaatgaggcaaaggaggacaacctacttgctgcaagactgttaattcgtctgatctcgacgtcataatcctccattaggcactcgtgaaaaagaaagcagatgggggggttgtgttcttggattacccgtatcgtgaatccaaacgccttccttcggcgcaagaggcgtgcaagagggtaaatgtgggccggtgtatttctgaagagtacccaggctcatgggagggcgtcccgcgggcgctgcagggtttgcacgtcagaaccgctgcgagcctccaccagagtttcctctggcttcaccctatacaggcatagttcaccttctttcgctgttcaccttggagacctgctgcggttatgagtacgacctggcgtgagaattattccttcccgcggattttcaaggggcgtcgagagcgcaccagacccagcagaggtgctgggctcttccggccattaaaccctagctccggacaaaccgatttcagctgttcaccttggagacctgctgcggttatgagtacgacctggcgtgagaattattccttcccgcggattttcaagggccgtcgagagcgcaccagacccagcagaggtgctgggctcttccggccattaaaccctagctccggacaaaccgatttcaccctcttgcacgccacggtcagttcccgggccagttttgattttccgcaaaattcatttgtatgggaaatcaaaaaaatcgctgttattgcctcaaacttccatcggcttgagccgatagtccctctaagaagccagcgtactgccaaagcaatacgggcgagttagcaggttaaggtctcgttcgttatcgcaattaagcagacaaatcactccaccaactaagaacggccatgcaccataagccgaagcctattcttgtccatctgtacgtgcgggtggtatcaccgctttctggcatggattctgacttagaggcgctcgcatattcacacacaacacacgccacctaacctatactttacataacctatactcaacataacctacactttacataacctatacgcatattcacacacaacacacgccacctaacctatactttacataacctatactcaacataacctacactttacataacatatactcaactcctcttggggcgcccaagccgcaccggccctagtggtcttggtgtggtggaaggatgccctggggaactgagaggggggaggtggattgccgtgcgcggcgtcggtggccctgccgctggtgctgtgttcggcgcgctctcacgagtgccattcagtagtactccctcctcttaattatagacacaaagacaacagagaggaagcgaatctatgctccaaagtctaagtactaagtcatatttctaatgctttgttctaaatttttataaatttgtttccggtctagctcctccggcagcttggcttcacaggttccaccagttgtgccatccagggaggctcctgagttggctggctaggcggtatcatcaactcctccctaggtccaggggtatcatttgcttcgattttctcacaggcatcacatgccaagcgaaatatgcgctccttcatcagacgatatccttcatgtgtcagatatgatcaatgatcagctacaattccgcctaaggtatcgttagaactatatatcgggcctggaaccatctaaaaggataaacgttcaattttcagtgattaacatcgctccttaacaaagtgttagctataaagttgtgtggaaaagtaaattcagacccacttttatctaaaagagactcttaagctgatcagttgagtatagatattgaatatcttatctttaaagctgaaggaatattatatagtataaataactatatataaatagatattagattaatattaaatctatattatttctaataaaaaccttctatagtagtaaatatatattgcacgtcagaaccgctgcgagcctccaccagagtttcctctggcttcaccctatacaggcatagttcaccttctttccggaccttgttacgacttttacttcctctaaatgaccgagtttggagagctttccggccctgagtggtggtttccctcctctcctgagcagcacctcacgatggagtacatggtccactcggaacctgattgagtttctaattcagcgataccattggatagtgatggtgaaaccaacaaaatagaaccacacgtcctattttattattccatgctaatgtattcgagcaaaggcctgcctggagcactctaaaccaacaaaatagaaccacacgtcctattttattattccatgctaatgtattcgagcaaaggcctgcctggagcactataattttttcaaagtaaaagtcctgtttccccgctacacccagtgaagggcatagggttccacagagggaaaggcccgggatgatattgccccgcaacgatgataaatggcgggattgcctcacctcgggaattaatagattgaattaccgaaacctactctctatcacctggctgagctaaggttggttttccatatctatccgagcttgtaacaaccatggtggttgagattatgctcatgcctgcatgaatgggctggttcgcagcaccgacatgtcccgtgagtaatatgactgattttgggtggggatggggagccgatcccctgcaaaccatccattccagtatctgggaagggcatccgccgagccggccagtcttcttagttatgtttggtgagcggcggttcgccgctacagaatagataggaactaaaactctcacctgccacttagtgtagggccctcagtcgtattccatccacgaacatacccttggtgtgtagtgtccatgaaggggtttgcccacggttcttggatggcgaggatgtcaaagtccatgatcttgacatcccgtagtagggtagccatgacgatgtcctttgatttcctgacattgtactgtagtattgagagtgatttcctgccaagtccagaaagtactgttcaatccttccctgatgaagcactgactgctggaaacgactgatattcgggattgtatcggtaatacgatcagttctctggattataccgttttcatcggggttctatcgccgtttatactgtcacattagtgtctgcctctccccttacgttcaatgtagcactcaagtatatcggatcatgcattaataatattggaggggaaggtcttaacgtgcctaacgcttatcggtggctccgtgagcttatgaccctggcaacggctgaagcgatttatggagtagagaatccatttatgaaagacccaacttttcgaagttgaccaggtcttggaagtcacccgcttcaatctgccggatgagggaaggggctttaaacatcatgttgggcccctcgtcaccatatctgtaatgtggtaacgcgtcgccactttcgtctgctgtggcagactcgtcgtcgttgtagtgtgccaccacgatcgtataatagaggatatactaataagaggcacgaaggagacgatggcaacgtagattgaatgtgaaggaactgaaggggaccttgcgaagcttcggctcacgacttgaattcctggaagggtagacctacatcagaacgactatgatctcctctcgtggaaatcctgccttcttatggttctctcacttacgcatcgcatccactcaaggagcaccctatctccgatccgaccttccgtcatcggatttggtctggcgaggcattactactaattgcccgcctcttacaagcatcattagacattgatcaactaggatgcgtgttggtgcttagttcactaatgctatcatgcaggtcacatctgatgcggccagactacgcgcagctgatgcaagcatccatctcagtaatgaactattagacttcattgcgttcagctgcagcaactatattcaatcacgttgccctcaagtttggccatgctaggcatttcaagcggagacccaaatgcacttaatcgctatctgtcacatcaccctggggaaaatcaactggtgtacctacatacggtgctcggggtacccctcgcctcccatggcatacagacctcatcttgtaagatgacctcactaagagcggccgtgccttgttcatatgtaactacccgtaactattcaggttgacttgcacttcattggtcactacggatatgtagagggtgcagcttcgcacattctgtcggatgcaggatagaggcaaattctggggatctccactccgagccttcgagaacctatcaaaatgcagttttgctacccccacgtctagcgggatattttatcatcatcttgtggtccctgacctcaggtgtcatgaccacgggggtgtggtacactacctgggcttaaccacaagcccgtggtgccagcactctaccacggacctgtggttgacgaaccaatccttttccacttctgtcgtttttggcggcactactcgtgccagcaccacctagtttgggggaggccgccaaaccggagggggaagcagcgcgtccgcgattactattataatattaattattatactatctaataaattatcttatttatttattaaataaattaaagtaattagagaattgataattagttattattttaataaataataaatcatagaattaattagtattcaattaataaagtaattaatttaaacataacatatagttatccatagaattctatataactaataatattaataataaattaattagatctaataatagtattaaataaatctaataattataaattaaataataatactatagaagaaataactatatctaataaactaaatataaatagattaagagaggtagaaaaattatttcttattaagctttttataaagctataaagtaattttttttaaaagagatttttacttataatctggatatggccatagagaactaattaaagttaaaaataaacctagtaattgattctatagaattaaattaataaaaagtaatataatttagaattaaatatctactaccttaagaaagatctttctagtattctattagactaaagataaattaaatctaagctacttttagaggaaaatacataaataaattactaaattaatatttaatagggtaatttaataaatatagtaaattataatctttctatttagaatatagtaaatataaagatatattaataaagatacaaaagctataaagagtatataaatagtaattattaaaattatttataagattataagagtaatattctaagctaaaagtaaaaatctaaaattaattttagatttgaattataattagtataatattaatatagattttatattaatataaaattaaagctagttttaatatattataattataaaataatgatttaaataaaaaactactaaataaatataaggaataagaatttaaaagataaaattaaaataatatatatatataaactagttttaaagcaacttaatttagaaactagaaagaaaattgaattatttagttaaaattaactataaattaaaagttattattagaatattttatagaatacaaataatagaaaataatatactaaaactaaataactctctaatataaataataattacaatctaattaaactaatcttaataatattagaaatagcaatatattatagtatttaatagtaattctatatattttttcttctaataaatagttagaaaatatcttatattcttcctatctagtaacattatttaaaactattatctattatcaaattatttatcagttattttccttttttttttgtatcctctttaaaatgtatttataatatatttttttgttattttatatttaaattatttagtttaagatttattagcttttaagatagtatttatatagttcctattatttatacttttctttatttattatatttataaatagagtaaaataatttaaatatttatatttatagagtaaaataatttaattatcattttaattgaagttaattataatataatttccttttttatatattatatttatacaattctttagtatttaatatattttctctttaaattcttagattatttatatctcttctaaatatctataaatactttttttaaatatgattaaactactaaataaattcttttaaagttggaagcccaattgactccaacagggggcgcgccgcgtacgcgtagcaggatattagccatttcctcaacaccacgtatcctagggggaaatgcacgtgtagatagctcaattacgtacgagacaatagcctcctaaagttggaagcccaattgactccaacagggggcgcgccgcgtacgcgtagcaggatattagccatttcctcaacaccatgtatcctagggggaaatgcacgtgtagatagctcaattacgtacgagacaatagcctcctcttcagattttataagattttagacagtcagattccccttgtccgtaccagttctaagttggttgttaaccgtacgccggacggccgaagcctgctaagttggtttttgcggctgtccgaccgggcagtgccgcgaagctaccatctgctggataatggctgaacgcctctaagtcagcattggtttttgcggctgtccgaccgggcagtgccgcgaagctaccatctgctggataatggctgaacgcctctaagtcaggactagtgaatgtccttacattgtagccgtgaaaaacatggtgtccatctgaggagcaggggtcgattgtggtgtctggcccatgacttgtagtgtggcagctggtagctcaagtcgcagatccttcaagttctcattgaagtatttgctactaccaccaagatctgcactagaggccgttcaacccgggctcacgccctattagatatgatcgtcgcatcttgctcctctagtcggcggtgcgccgggtgcgcagacgggtcctcacttggtggatgattgtgccaagccgatggaagtttgaggcaataacaggtctgtgatgcccttagatgttctgggccgcacgcgcgctacactgacggcgccagcgagtactcccttggccgaaaggcctgggtaatcttgttaaactccgtcgtgctggggatagagcattgcaattaagccgatggaagtttgaggcaataacaggtctgtgatgcccttagatgttctgggccgcacgcgcgctacactgacggggccaattataccctaccgcctgtatttggagaactagcaggcatttccttcctgtgatcatcctacggatgagtcatacgattgctacaccttgcaaaacacaactaacacctgaaatatgagttggcgaaataattacataattaaccccttaacccgagtgaaagctgaaggaattatccaagatctaagacttagtctagggtaggctggctatagggtagcctgggtataggttaggttgtctgagaatatcctaggagtaggtcgtcgccgttgctattcttactcaaccaattaattaaaaatgggtaaatattgcatttgggctcacgtggggtctatatggcccttctgagttgtttgttactaaatagtaaagcagaaaaggtcccgctagcaagcgtagaccttagaatggttgctagggatcggacgatgttaaaaattgactcgttcggcaccttacgagaaatcaaagtgcttgggctccagggggagtatgttcaatttggctgcgaacatgccgtttccattcactctgctatgtgaccttctcaaccgacttgaaagaaactacaagccattgagcatcgacaagacccaggaagtccacgcccgcaccgttgtctcctggtttcacaaacacaatgaggccattccacgacgaggcacagaagccattgctttcctgtcctgtccccagggccttgccattggcggagttgatgacggtgatgaggtccggaacagccgcaatcactgcctcacttccatcatcgcgccgatggcgagcgagcaaattctcgttcatgaagggaatgtgaaggtctccgccgaccccagatccaacgcagcttgccgtttgtatcatccttctttagctgtacgagccgtttgaagatgccgctgttgatgcggcaggtgccggtggctccaatcttcaatgctcgaagaactgtaaagaggtcagggcttgagaagaggttatctaagaagacgtgatatatggctggcggcatagcaagaagctggtactcaggtgaatggattctctccttctgtcttgggaccccgacatcttgtctagtttcttgactttgttgggataaccggggtagaatgaacaaggtagagcaacaggggagcaacaggagagaaacaaagtctgcatatacacagacaatcaggcagcgatacgatcagtggccaagctcaaaggaaagtcaggagcatacctcctccgtaaaaccacacgactgatcgacgatcttcatcagcgacacgtccgggttgaaatcagatggatcccgtcgcaccaggggatacggtccaggtgccggaatattgaccggcttccctttcgccacacggcgcaaagtgcgcctttgaaacggaacttccctatggcattggtttttaatctaataaatacatcccttccgaagtcgggattttaagcatgtattagctctagaattaccacggttgtccaagtaaaaattagagtgctccaggcaggcctttgctcgaatacattagcatggaataataaaataggacgtgtggttctatttggttggtttctaggaccgccgtaatgattaatagggacagtcgggggcatcagtattcaattgtcagaggtgaaattcttcgaccagaaaatggaaaggtactacatagcacacccagacactctcaccatgatcatgcaagcacccggccagttacaggcgaccagaaaatggaaaggtactacatagcacacccagacactctcaccatgatcatgcaagcacccggccagttacagagcgaccagaaaatggaaaggtactacatagcacacccagacactctcaccatgatcatgcaagcacccggccagttacagtgcacctaccgaccagaaaatggaaaggtactacatagcacacccagacactctcaccatgatcatgcaagcacccggccagttacagcgcacctaccctactaaaacaacccacaacagtatacataagcaactggaagtcagccatagcgtgtatcaccccgctaagagaaggagcctgagaaacggctactacatccaaggaaggcagcaggcgcgcaaattacccaatcccgactcggggaggcagtgacaataaatactgatacagggttcttttggatcttgtaattggaatgagtacaatttaaatcccttaacgaggaagagaaggagcctgagaaacggctactacatccaaggaaggcagcaggcgcgcaaattacccaatcccgactcggggaggaagtgacaataaatactgatacagggttcttttggatcttgtaattggaatgagtacaatttaaatcccttaacgaggaagagaaggagcctgagaaacggctactacatccaaggaaggcagcaggcgcgcaaattacccaatcccgactcggggagggagtgacaataaatactgatacagggttcttttggatcttgtaattggaatgagtacaatttaaatcccttaacgaggaaattgatcagggaactcaagccactcagggatcaatagaagttattgcgatacaagtggcctcccaaccgctcactatacaataacaaatagttaccctacctagctaatttcacctctcaatctcaagctacactaggtcgtttctgggccaaattatccttgatcaactgtgtcggggttggggggtctctctcttttccaatatatcggggttggggggtctctctcttttctgttatatcggggttgggggcctctctcttttctattatatcggggtttgaaaagcaaaatcaaggtagttaggttgttagtttcaggaacgagtccgtatttaagcatctggtgagatagaaatctggcagctgtcttggtttctgcccagtgctctgaatgtcaaagcgaagccattcgaccaagcgcgggtaaacggcgggagtaactatgactctcttaagcggtctttattgggcgtggtttgtcactttttggaattttcgaccagaaaatggaaaggtactacatagcacacccagaccggtctttattgggcgtggtttgtcactttttggaattttcgaccagaaaatggaaaggtactacatagcacacccagaaactctcaccaaggacgccagagttctggcgcccggtctgtctctcgggaagcggctgcagggtagccagtctatctttacatcccgcccatctccttctccagtatcttaggcgatatagccttcagggtagcttagaagagatgggatggcgggtttacaaaagtctaagtcgtctgcaaaggatttgaccccgctcgttttaaaattacaatacgcgaaatactacagcacacttctagtaccgtagagtaaccactcagtgggaatctgcaagatacggtacagttgaagagatttcccacagcggatcggaccagcttgttacagttgaaccactcagtgggaatctgcaagatacggtacagttgaagagatttcccacagcggatcggaccagcttgttacagttggcccgagacgctgtgagtggtttgctgcagcgccttaggctttcgccttcagcactcgcgcccctctctcataggtgcactatttaaattctttaaatatatatataataactataaattccttattataaatagaataattaagttctatactatatagtttcacacgatatgtttaaaacacagaaagccacaggcgcggatgtttttcttttcagagctatctttcataactggagcgatattcgttgtattgagatactgcgggcacatataggagctctgaaagcgggcgctcatatcctcatcaatgatgtggtttaataaatacatcccttccgaagtcgggattttaagcatgtattagctctagaattaccacggttatccaagtagtaagggactatcaaataaacgataacttatataatgagccattcgcagtttcgccgtataattgcttatacttagacatgcatggatccattgatcagggaactcaagccactcagggatcaatagaagttattgcgatacaagtggcctcccaaccgctcactatacggggaaggactgggaggttagcgcaagggtgggtttcactccttgcggtatggctagctggctggcattaacacaaaacacaattacgctagccaatcgctgccagccagccccgttctcgaccgggccaatgatgagatcgaagtcgtcacagaccctcggttacaccagcatcccttccgaccatactatcaagaaatagctctcaatctgtcaatcctcattgtgtctggacctggtgagtttccccgtgttgagtcaaattaagccgcaggctccgcgtaataacacaagagcctgcgcaagttgaaaagcctctcacatcacgcaaacgcaagcaggctgtgccgataaaaaaagacgccactgtaaattccaccacagcgtgcatgcaccaccacaaatccaaccacagcacatgcacatcgccgggaaccaaccttcagcacatgcacctcactgggaatgccaccaaagcatattcacacacaacacacgccacctaacctatactttacatatcaccccgctaaaattccaaccccagcgcacccaacccactacataatcaaccacagcgcacccacaccaccacaaatccaatgaatggattaacgagattcccactgtccctatctactatctagcgaaaccacagccaagggaacgggcttggcagaagcagcggggaaagaagaccctgttgagcttgactctagtttgacattgtgaaaagacataggaggtgtagaataggtgggtcagtccacaaatgaccctctggcacaaccgactggcccatctgagcgatgcgaatttacggcggctgaagaagcaagcccacggcttcttatgcgagtgttcgggtgtcaaacccctacgcgtaatgaaagtgaacgtaggagagagcttcggcgcatctccgaccgatgtcttttcacaatgtcaaactagagtcaagctcaacagggtcttctttccccgctgattctgccaagcccgttccctttgctgtggtttcggcaacaacccacagaggtcaaaaatgatatagcctatcctcctcgcaataaaggtggcgtgtacaaataagtcttgcctaattcttgcaccaggcatttcgaccatgcccaggtagcgggatccagtgaatggctgaagctccgcggatcattgctgatcctctttgccccaccttctaccgcccaaaaatgggatccaagccaccttcttgtacctcagtcgctccgtattgtcactatggcaatcattcttttattctctaagtcagaatccatgccagaaagcggtgataccacccgcacgtacagatggacaagaataggcttcggcttagcggcttagcaggcgattactctacggtactagaagtgtgctgtagtatttcgcgtattgtaattttaaaacgagcggggtcatccaacctctatgctggctgcaatagattaatttacaaagggggcaactgtaatgatgcaccaggtggctcttttacgtactgaggtccgggatcttcgtacggcaaatgaggtactaagcaagcgccgaagagctaaaaaaagccgcgtacggcttggtagtacttattttatagtagtattaaaaaaaaataaaaataaggaaattagatttcctagtgatatatataaagctcgaaaagctcagaggttgagcggaacgttgaagttgtttaggtcgtgagttcgaatcccaccttgggcataattatgttattcgccgccgtttacccgcgcttggtcgaatggcttcgctttgacattcagagcactgggcagaaatcacattgcgtcaacactttactataaataaaggtatatcctaagatcaggtaatatataatctgatatatattttttaagaatataattagtagtctaaattatatctatttaatttattaatttattatatagcttatttagtattactataaatacttatagagaatagaaactaattaaaagaaaaactatattttaagaataattatctatttatatagatctattataatctaatatataatttatagttttaataccgtcttctgcatttcgtgcaggtgcttcgttcggggacgtctcttgcattgccagttgctgcgaatggtccatggctgtctcctaggatcgtcttgtcgggcaagtgtgtcaacctctccgacatttgatggaattgtcgtatcttgcagtccgaaagttcggtggagtaaagatagattgacatgtttgatatttaaccgatactaggttagagaaatgcggaaatctccaaagcacgtgtcatctccgaaatctccggaatgtccgacctggcgtcggacattccgaaccagtggcgtttggctcaaagctaaagactcttcggacaattaccacatactgtggtccgtcggacaattcttttgtcgtggtccctcctcggaagttccattcgtaggctttgctgggtagagactttggcgattttcccgaggctgacgcccctgtttcttgcatgtatgatctagtttctcctatagcaaggccttcacttcaataactccagggtgggtgtggccatgacaaatcacaagtgctccaactaggatggcgttacagtctgtatgcctccccactcctctcatcttcttcagccattagatgttggctgctttggaccactaaagcagtcatacggaagagaggttgagaagctaatgcggatgcatattacccacattagcaagcttgagtttctctcttcctttcgtacccgccgaagcaacagtaggtatgttcacatgggtttgggagttgtaaactcggtaatgatccctccgctggttcaccaacggagactagcttatagcggttgcaactactagcctctagcgattgcagccactggctacaatcgctaataaccccctgctaacactagccaatagcgattacgatcactaaccaatagcggctgcagccactgtgggtcagtggctacagcccgctatgaccgctacggccagcaaccttgattgggagaatgaggaccgagcctcttcaaccggggagcttggttctggtctatgatgtggtgcgcaataagatccgcaaggatactgcccgcaagttgctgccgcgatggcttggcccatacaggatagtcgatcgaagcgaacactcctaggcgggcgcctgatccggggcacacgaggcgcccggggcaatcccgccgaagcaacagtaggtatgttcacatggggatacaacatttgccatcaggtgaacgcgtaattatcgtgtataggagtcattgggctacagtctacaagggcatacattgccaactattcaaggattttgagtggtcacattttacgagctgagtttggaagtggagatatctattggctaagtcagcagagtccgttacttaatttatctctcgggctgatgagaaccgcctggcttgcctgcccgtcccgccctgcccgtccgctctcctgcacatagtcccggaatgaattttgcggaaaatcaaaagtggcccgggaagcagctttagcgggttttagagtagtttttagtcggtagacctttgagagaaattagatagaattttctggtctctctcacaaaaataagattcttttgcgctatattttgcactatattaggcaaaaaaagtcatgtatatcggtcgcgcggtttggtggccgtgagtcgatttttttgatttcccatacaaatgaattttgtccttagcggattccgacttccatggccaccgtccaactgtctggatgtactaacaccttttgtggtgtctgatgagcggctactctggcaccttaacctcgcgttcggttcatcccgcatcgccagttctgcttaccaaaaatggcccactagtattggcgccggtgaaataccactactcctattgtttttttacttattcaatgaagcggggctggatttacgtccaacttctggctttaaggtgaggaggcggccactcgggccacaagggtaaacgcgaccttgaagctcgaggaagaggttcccacacccacggaggaggcggccactcgggccacaaggggaaacgcggccttggcacccaggtgctggctgccgccggccggttgcccggctagtggctgcctgctcccgaggcgtcctcccaaagcccaacgttatcctaagatcaggctatatataatataatctatataattagtttttaattaagttctaatctatatctaatctttaattctattttttttaactttttattatatagctagctaagatatagataatagtaactctaaaaactctaaaaaaagcttattaagtatataacgatcagcatcgatacagcagagaagtgtgttttgcatcggcctgcgccgatctgaagacgcgactaggccatgatgacaaatgcgagcccgcagaccattatacatcgccctgaagcagctgatcctttggcctcaagaaggtccagataggccgcttgcctcggccccttacgacaccgcatataatataatttctaaattaaaaatattataaaactactttttctatattactaaaccgctttagttattattataagttatataaagtaaattaatatacttaatcttttatatattaagtatatctatataaagctaatagtaatatattctatatttaatatattaccccccctggttgtgcgtcgtcccgagggcgctttcgggaaggcggggtctgtggggttgccgatgacatcggggcttgaggagggtgggcaagccgctcggcggaacctggtgtttgcctcatcatactaggagccgggccggatcccatacttgcagaaagtgccatgttcgatgcaatggcaatttgccaatctggtaaggcaaaggctccttctgttcgaagcaataacgaaaagaaccaaagcaatacgggctagttagcaggttaaggtctcgttcgttatcgcaattaagcagacaaatcactccaccaactacgaacggccatgcaccaccacccacaaaatcaagaaagagctctcaatctgtcaatcctcattgtgtctggacctggtgataggcgatatagccttcagggtagcttagaagagatgggatggcgggtttacaaaagtcatgtatatcggtcgcgcggtgtggtggccgtgagtcgatttttttgatttcccatactctcttcggctcctgtgagcggtgacgagtccgaccccttcgtgtaagtccagttcacaccggtaaccttagaaaaacataaaaaaatgtaaaaataaaaaaaacaaaaaaaacagatagcttagacaggtatatagatggggaattgaattgccccggttgggggccccccccttgcacgtgcctacccggtaccccaacttcaaaccggtctcccgccttccacgcggatcggagggaagtgagaaggccagtatttcacagagcacctgctaactagcccgtattgctttggcagtacgctggcttcttagagggactatcggctcaagccgatggaagtttgcggcaataacaggtctgtgatgcccttagatgttctgggccgcacgcgcgctacactgacggagccagcgagtactccctctcaccaaccgaatgtactagccctgaaaatggatggcgctcaagcgtctcacccatacctcgccctcagggtagaaacgcttagttccttctaatttttctaaaaagaaagctataagcttaacttcagaagaatataagaaattattagatctagctggtctctggcatataagactagtatacgaccttaataaagaaaccacaaccgctacattcctcaccggttcaacacattcctcgccgccaaacctgcgtgtactaggcgcagcggttgagtttcaaggtcattgtcacctagtaactgcgctctttaggctggactgttaacttactttcctctcaggctccttctccggggtcgagccctaaccctccgttacccgttgcaaccatgtttggccaatacccaaacatcgcaagttgatagggaagaaatttgaatgaaccatcgccggcgcaaggccatgcgattcgagaagttatcatgaatcaccagatgtgctcattgccgctttgttcaatcgcccggtctacgtgggctttgaggtttcgagggttcatggctctgatgttagctacagtgagagggtttctgatgttcacaatgatctcgcgcagggcttgatgtgctcattgccgctttgttcaatcgcccggtctacgtgggctttgaggtttcgagggttcatggctctgatgttagttacagtgagagggtttcgagggttcatggctctgatgttagctacagtgagagggtttctgatgttcacaatgatctcgcgcagggcttgagtggtggtttccctcctctctgggccagtccggacgcctcactgagccattcaatcggtagtagcgacgggcggtgtggacaaagggcagggacgtaatcaacgcaagctgatgacttgcgcttactagggattcctcgttgaagagcaataattgcaggcttcgctttgacattcagagcactgggcagaaatcacattgcgtcaacaccactttctggccatcgcaatgctatgtgttaattagacagtcagattccccttgtccgtaccagttctaagttggttgttaaccgtacgccggacggccgaagcctggaattagatgaagatagataaaattaatagaagtggcccgctcgcttgtgtggcccgctcgcttgtggattacgttatttctcgtaggaaacagctgactgcaagagccacaggtccgacggttacggtcatatctgtaggcctcttccatccgtactaccacaagctgccggaggagctagaccggaaacaaatttataaaaatttagaacaaagcattagaaatatgactttgttggtgtcagtgacaggctatatagtcaattgggcacagcaatcagcgcgagcgcgctccgtttttgctagtgtactcgggtcaactgtaacaagctggtccgatccgctgtgggaaatctcttcaactgtaccgtatcttgcagattcccactcatatatattgccttcatccattctcaaactttaaatatgtaagaagctcttgttgcttaattgaacgtgagcattcgaatttatcaatactaggggggcgtcttggctacggcggagttgctgatagaagcgctcgggacgctggaccaagggcctatgctccgaagctgaggcctcttctcgcaggtcgcggatgaaagtcatcaaaactggggaacctcgcgtggtatcggaatcccgcactgcgttgtgcagagtatggagcaccgctgcaaaactctggtgatgctcagccgttgtcgcaggcacagctcaaatttgaaatctggcgcaagcccgagttgtaatttgtagaggatgtttctggcgacgtgccttccgagttcgctggaacgggacgccatgctgaatttcaccaatcctccgctgaacgacaaattagcttctttccgaggatgataccggttggtttctacaaccggattgttccgagccaattggttgatcttgaccacgtatgcccttagcctaacagtgtttccgtaagtgcacccttacaagtgcaattggattgtagccttctgtctaacagcgcttgttaatttacttttccacacaactttattgctaacactttgttagggagcgatgttaatcactgaaaattgaacgtttatccttttagatggttccaggcccgatatatagttctaacgatacctcggcgcatctccgaccgatcctgatgttctcggatggatttgagtaagagcatacggggccggacccgaaagaaggtggactatgcctgtaacattcggttggtgagttgttacacagtccttagcggattccgacttccatggccaccgtccaactgtctggatgtactcacaccttttgtggtgtctgatgagcgtctactctggcaccttaacctcgcgttcggttcatcccgcatcgccagttctgaggcgcactttgcgccgtgtggcgaaagggaagccggtcaatattccggcacctggatgtgggttttgcgcggcaacgccactgaacgctatatcgcctaagatactggagaaggagatgtgcgggatgtaaagatagactggctaccctgcagccgcttcccgagagacagaccgggctggatttacgtccaacttctggttttaaggtccttcgcgggccgacccgggttgaagacattgtcaggtggggagtgtggctggggcggcacatctgttaaaccataacgcaggtgtcctaaggggggctcatggagaacagaaatctccagtagattggggcaattgcattagcggtcacaaccgctgtaacggccgctgtagcgaccgtattagcgatctcgtattgcgctgtagcagctgcattagcggtcctcgtatccgctgtagcagctacattagcggtccaaaagggtaaaagtccccttgattttgattttcagtgtgaatacaaaccatgaaagtgtggcctatcgatcctttagtgcttcgacgtgtgaagctagaggtgccagaaaagttaccacagggataactggcttgtggcggccaagcgttcatagcgattcaaccctgaataacttcacaactaatagcccaggcgggaagcaaattagataaaaagtatattcagccaaagggcaagccaatacgtcattctcagatattctggggtgcctttggttggaatattcgtacatctttggtgccgcttcttggagacccggacagcgcaaggggcggtaagaaacgatgccctgaggagtaggcggacgtggaggtcagtgacgaagcctagggcgtgagcccgggttgaacggcctcgagtgcagatcttggtggtagtagcaaatacttcaatgagaacttgaaggaccgaagtggggaaaggttccatgtgaacataagttatcgtttatttgatagtaccttactacttggataaccgtggtaattctagagctaatacatgcttaaaatccctacttcggaagggatgtatttattagattaaaaaccaatgcccttcggggctctctggtgattcatgataacttctcgaagagacgaacttggtatagctgttgcaagaaaggatgccactatagcccaggcaattgcttcaagcgaagcggatactagcgatgtcgttctgagcgaagtgatgtgaatggcaaagataatatccatacaaatggtagcgatggtcgcaagggaaacttcggcggaaaccagctactagaaggttcgattagtctttcgcccccatgcccatatttgacgatcgatttgcatgttttatagggcctatatcctctaaaatccttagataagaggtcttagtaactagcctcttctcagggatataaatctgatagattttagagactctgcctggggcccccgccgtcgtctccgcgttcagttgcgttgccgcgcaaaacccacatccaggtgccggaatattactctgcctggggcccccgccgtcgtctccgcgttcagttgcgttgccgcgcaaaacccacatccaggtgccggaatatggaccggcttccctttcgccgacaagaataggcttcggcttagcgtcttagcaggcgattactctacggtactagaagtgtgctgtagtatttcgcgtattgggagcttgcgaagaaggatattctaattgattcatcaccaatcagcaagatgaccttccttcagtgttatacaaaggctcgattgatcggtctaacagatacgaatattcgctcggagcacacccagacactctcaccatgatcatgcaagcacccggccagttacagggcacctaccctactaaaacaacccacacgcgaaatactacagcacacttctagtaccgtagagtaatcgcctgctaagacgctaagccgaagcctattcttgtccagctgtacgtgcgggtggtatcaccgctttctggcaaaaaaaagggggataggggacccaagaccttctgcttccgagtatgacactgtgagcaagctttggcaatccggccacgtctgcggggaacggacctagattccggcccgtcttctgcatttcgtgcaggtgcttcgttcggggacgtctcttgcattgccagttgctgcgaatggtccatgggggttgaaatgacgctcagacaggcatgcccgccagaatactggcgggcgcaatgtgcgttcaaagattcgatgattcactcttcgtcctacgatctccctgtaccatggtataacaagaccacgcaaactattcagctaccctgtagttgatagagcccgggctcggacatagattctggcccgtcttctgcatttcgtgcaggtgcttcgttcggggacgtctcttgcattgccagttgctgcgaatggtccatggccctgcagccgcttcccgagagacagaccgggcgccagaactctggcgtccttgtaatccatctcccaaaccccctacgcagcccggtcctgtaagcagtagagtagccttgttgttacgatctgctgagggtaagccgtccttcgcctcgatttccccaatacaggctcatgggagggcgtcccgcgggcgctgcagggtatgtaaaatcaaaaaagttgttaagagccgcggtaaattatttcccaggctcatgggagggcgtcccgcgggcgctgcagggtatgtaaaatcaaaaaagttgttaagagccgcggtaaattgttgatctacacctcctatgtcttttcacaatgtcaaactagagtcaagctcaacagggtcttctttccccgctgattctgccaggtcatcttgctgattggtgatgaatcaattagaatatccttcttcgcaagctcctcgcgataggctctcttgaccggtgaaaaaactgatatatcaagcggctgtaatacgtgcgatgaatgcgaaggtaagaaaagaaggaatatatttagttgaatataagctctgctgctctctgtcatcctttgcagccgcctcccatatctctcgcatgcctcttctaccaacagaaaaaggattgctttccatctctgcggctacctgagcctcaaatggcgaccctcctccacacacacagccctgtgtgagctcacagagagccgctgagcccccggcactggagcacacttctgccggcggaacgaaaattacacgagcaatcgcggagtgacgcgtaaggaaaagagagaggttgggactgacaaggtgggcgattgaggggggtgggcgattgactaggtggcgacttacgcacaccccatttctagccggccacatcccaactaaactaagtccggaaaacctgcaccccacaggctatctcaccgcctgtagctcacgctcagtagaccggccctccctgtatctagccactgtcctcgaccgatatatatagcttttataagacctacttttatctgaaagaggctcttaagctgatcagttgagtatagatattaaatatcttatctttaaagctgaaggaattatccaagatctaagacctagtctagggtaggctggttatagggtagcctgcgcacatctccttctccagtatcttaggcgatatagccttcagggtagcttagaagagatgggatggcgggtttacaaacgtcatgagcggacgggcagggcgggacgggcaggcaagccaggcggttctcatcagcccgagagatatgaaagagggcagaggggtggggcgggcagagcagaagggggtggacataagcatgctggcgtttacgcaaggatccagctgccgacgtcttctgctgcaagatttaatagagtaaaaggtttgcaaacctttaaaaaaaagactttctgtttcttaggccttggacataacccggctcgaccggacacgtaactttgatgagactggctttataatgggcataatctcaaccaccatggttgttacaagctcggatagatatggaaaaccaaccttagctcagccaggtgatatatcggtcgaaggttttggtggttgtgagttgattttttagatttcctatagtaataaattttgcggaaaatcaaaagtagcccgggaagctgctttgggaggacgcctcgggagcaggcagccactagccgggcaaccggccggcggcagccagcacctgggtgctgatgcgcttagcaggcttcggccgtccggcgtacggttaacaaccaacttagaactggtacggacaaggggaatctgactgtctaattgccccgggcgcctcgtgtgccccggatcaggcgcccgcctaggaaacttaattcttgttttattttggaatcttcttagtagtttttacaaataaataaaaactttcaacaacggatctcttggttctggcatcgatgaagaacgcagcgaaatgcggatggatttgagtaagagcatacggggccggacccgaaagaaggtgaactatgcctgtatagggtgaagccagaggaaacctgcaaggatgctggcgtaatggtcatcaacgacccgtcttgaaacacggaccaaggagtcgtcttcgtatgcgagtgtgcgggtgtcaaacccctacgcgtaatgaaagtgaacgtaggagagagcttcggcgcatctccgaccgatcctgatgttcttttcctccggcggctcgagtacatgtagcaatgcgcggatcgactagacatccctctatcccagccacaatgtaccggaccccgaggactcgtggttcaacgggatccatctccgcctccctcgcggtgctggattcgagattgagatgcagtgggggcacataggatggtccataccggcagctttcggctatacattggccaagcccaagagacgcgtggtcatcgtggtaggtgatggtgctttccaaatgacggcccaggaggtttcccaaatggtccgatggagggttcccatcatcatccttttgatgaacaacaagggctacaccatcgaagtggagattcacgacggtttgtacaaccggattcagaactggaagtatgcttctcttgtccaggcattcaacggcgaggaaggtggagggcatgctctcagcttcgaggtatccaccttttttgaagtggtggtcagaataatcagcttcgcgagctctttgaaatactggccttctcacttccctccgatccgcggttggccgaaaaagtatattgatcagtatgtgatacgatactgcagtctgccgtatgcaatcccgacagtgatagaccactggcatggacgatcgaaacccactaatagggaacgtgagctgggtttagaccgtcgtgagacaggttagttttaccctactgatgacctcgccgcaaacccactaatagggaacgtgagctgggtttagaccgtcgtgagacaggttagttttaccctactgatgacctcgccgcactggtaattgagcttagtacgagaggaaccgctcattcagataattggtttttgcggctgtccgaccgggcagtgccgcgtttcgtgagggtcgacgcccactatgaatcacccgccagcgaagccgaagccgtctagcctgtccaagtgaccactcagtaaagttgaagcatttgcgaatctccgagtgcagcgccttcgtcgggtgcttcgagcagcggctagggatcgagttcattggataaggatgaagaagaggctcgctaatcgtgatatggtgagaaacaaggagttgagtagccataacgctggaggaggtgcgttattttcgttgtattgtgaaagggggaaattgaatttcacctctgacaattgaatactgatgcccccgactgtccctattaatcattacggcggtcctagaaaccaacaaaaacgaaacccgactgctcatgcggagaaaaatacaagcaatgaacatctgggctggtacgcccgcgatctggttcaccatcaaccccaacgacatcaacaatccggtcaattctactccaagaaagacggacagtatgattattatcgagtcttcgctgacgatgccacttatcatcacggtcatggacatgcttattcgaactatgaggggctagcgttagcagggggttattagcggttgtggccagtggccgcaatcgctagaagctagtggttacgatcgctagcggctagtggctgcgatcgctaacggctagtggctgggaccgctaatagcggtctttaacagctaatttgatcactaatagtctattttgccgacttcccttatctacattgttctatcaaccagaggctgttcaccttggagacctgctgcggttatgattacgacctggcgtgaccaactcgttttcctaaccattcttttaattacccaccgacgagcgacacatagcggggcacaggcttttcatactggacataaatcacgacgctggctgaactttcgagccaaggcagttcagtataaccgaaccacccccccaacgcctggaacaatcagatatatgcctctacgattacatgtctatggtcagcctggtccgtagccgtggccgggatgaggatgagaaccacatctctctcgcacctctcgacgggccctctgtgacgtgccatggctggttgcagaagctccgtaacaacgtcagtacggtcgtttattactgctactcgcagtgccgtcccgaaaaagtcctcatccttggaaaccttattaatgtccaagttgtatatcggtcgcgcggtttggtggccgtgagtcgatttttttgatttcccatacaaatgaatgttgcggaaaatcaaaagtggcccgggaaccgaccgtggcgtgcacgagggtaaatgtgggtcggtgcacctatgagagacagtggcgtgcattcgctgtggttggatttgtggtggtgtgggtgcgctgtggttgattatgtagtgggttgggtgcgcgggggttggaattttagcggggtgatacacgctatggctgacttccagttgcttatgtatactgttgtgggttgttttaggacggcctgaaacaatattatacttcgatagatcttttgatgctttcccgagagtgggggcttaatcacggtgaggacagcttatctcaccattcgtgcttgcccgtaactatgatacggagattcagattccgctgctgcatcgaagttcagacaccgacgcacagggtcctcgcagtatcttaggcgatatagccttcagggtagcttagaagagatgggatggcgggtttacaaaagtcatgtatatcggtcgcagtatcttaggcgatatagccttcagggtagcttagaagagatgggatggcgggtttacaaaagtcatgtatatcggtagcgcggtttggtggccgtttacatggagcagaaccgtggcgcctactgcctgttgacttcgctctgtgccttcgtcatgctccagcctggcatgaacatgccgaaagagctctcaatctgtcaatcctcattgtgtctggacctggtgagtttccccgtgttgagtcaaattaagccgcagcctacagcggacacgaggtccgctaatgcaagcgctacagtggacacgaggtccgctaatgcaagcgctacagcggacacgaggagtagtaaggtactatcaaataaacgataacttatataatgagccattcgcagtttcgccgtataattgcttatacttatacatgcatggcttaatctttgagacaagcatatgactactggcagaatcaaccaggtaactatcgttcgccggggttggcgaagagatagtgtgagaaatgaagtgctgataaatattcgcgagtctgtaccacgaactagataaatttaaaaaaaaagaaaaaaaaaagaaaagaaaagaaaagaaaagaaaagaaaagaaaagaaaagaaaagaaaagaaaagaaaagaaaagaaaagaaatagacccatccaccatgatggagtcgaatgcacactctagtgccagatccgcatcgctcggcttcaagcagtggtcgaggtacggacgtttgacaaagttggagcttatgtataacaataagcacctcgactcagtaggatatatcaaaatgtactggcttgacccatacaaacggacgtttgacaaagttggagcttatgtataacaataagcacctcgactcagtaggatatatcaaaatgtactggctggacccatacaaggagatgattatcaaggcatgggtggataagcacatgcattttggtaatatagctacgtcgaggtaggtgcacgaatgatgcacttgcagcggtcgttgcaactgctggcagccatttcccggaccggtcaaagtcccttctggccatattcggtttgcctgccaatatttgctacagtgttctaattaaaatgttagagcgcgtcgtaaaaaatgcgacgaagagatccctagtcggcatagtttatggttaagactacgacggtatctgatcgtcttcgatcccctaactttcgttcctgattaatagtataagcaattatacggcgaaactgcgaatggctcattatataagttatcgtttatttgatagtaccttactacttgtataaccgtggtaattctagagctaatacatgcttaaaatcccgacttcggaagggatgtatttattagattaaaaaccattgagacaagcatatgactactggcagaatcaaccaggtaactatcgttcgccggggttggccaccagcgcccacgaggagcactggagagtctctccaagggatatctttctggcctctagggcttggagatacagcttttcagcctccttatatcgcccttgactgcggaaggtacctgcgaggcttactatactgcgtaatgtatctggatgagtctctccaagggatatctttctggcctctagggcttggagatgcagcttggcggtgtccgctgcacgtggcgatctcccgttgctcagtggtaagtttagccagcggccatccatccacagaacccatgcagcgccgaaaactaacctgtctcacgacggtctaaacccagctcacgttccctattagtgggtgaacaatccaacgcttaccgaatgctgcttcggtatgataggaagagccgacatcgaaggatcaacagaacccatccagcgccggcgagagcagagctctccccagaccaggcatcctcagtacgacgtaccgcacgcggccgctcagaacccatccagcgccggcgagagcagagctctccccagaccaggcatcctcagtacgacgtaccgcacgcggccgccttcgtgagggtcgacgcgttaatccattcatgcgcgtcactaattagatgacgaggcatttggctaccttaagagagtcatagttactcccgccgtgtacccgcgcttggtcgaatggcttcgctttgacattcagagcactgggcagaaatcacattgcgtcaacaccactttctcgcggccgctttcgtgagggtcgacgcccactatgaatcacccgccagcgaagccgaagccgtctagcctgtccaagtgcccactcagtgggaatctgcaagatacggtacagttgaagagatttcccacagcggatcggaccagcttgttacagttgaaatccctagtaagcgcaagtcatcagcttgcgttgattacgtccctgccctttgtacacaccgcccgtcgctactaccgaaatccctagtaagcgcaagtcatcagcttgcgttgattacgtccctgccctttgtacacaccgcccgtcgctactaccgcttgaatggctcagtgaggcgtccggactggcccagaggtcagtgacgaagcctagggcgtgagcccgggttgaacggcctctagtgcagatcttggtggtagtagcaaatacttgaatgagaacttgaaggaccgaagtggggaaaggttccatgtgaacagcggttggacgtgggttagtcgatcctaagccatcatcccgcatcgccagttctgcttaccaaaaatggcccactagtattgatacattcgaatgctcacgttcaattaagcaacaagtagctggttgtggtttctgcctacccggtaccccaacttcaaaccggtctcccgccttccacgcggatcggagggaagtgagtgttcgcttcgatcgactatcctgtatgggccaagccatcgcggcagcaacttgcgggcagtatccttgcggatcttgttgcgcaccacatcatagaccagcccccgccgtcgtctccgcgttcagttgcgttgccgcgcaaaacccacatccaggtgccggaatattgaccggcttccctttcgcccgaccgatatacatgactttttttgaagtggtggtcagaataatcagcttcgcgagctctttgaaatactggccttctcgcttccctccgatccgcgtggaaggcgggagaccggtttgaagttggggtaccgggtaggcagaaaccacaaccagctaccgaccgatatacatgactttttttgaagtggtggtcagaataatcagcttcgcgagctctttgaaatactggccttctcccttccctccgatccgcgtggaaggcgggagaccggtttgaagttggggtaccgggtaggcagaaaccacaaccagctacctaataaaaaccttctatagtagtaaatatatattatacttatagagataaattaactaataatcttatataactaacttttcttattcatcttcaaaatcctgaacaacacacttcagttttggaaaagcccttgcgagttcgatagaggctgggccatgtgcccccccaacatctacaactgttgagactttcgtccagtcgaagcctgtgaggagcagactgaagtcttcgtttgctgcaaatccgctcattgccttcgcaaagcgttccattcgaaccggcatcggcaaccgagttttgttatattgatggcttacccttcattgaatgcttacgatcgcttaccgcattagtcggctccgttgacccttgccaaaaccctacagtgagccgctggctgcaaatggaggcttcagtatcaaaattacttgtggctttgaccaactctcacacaccaagaccactagggccggtgcggcttgggcgccccaagaggagtgctcagcgcacagcttcaaccatggcggtggccgctgcacgtggcgatctcccgttgctcagtggtaagtttagccagcggccatccatccacagaacccatccagcgcctgcctgatggatcggaagaaaacccggagttaatgtttaccggaattcacggaacaagggtcttgtgggttgccccccccacaatggcttggtggtatcatgggtttcctactcatcccggtattcggtgaagccatcactatatggtctcccctttcgccacacggcgcaaagtgcgcctttgaaacggaacttccctatggcttaggatcgactaacccacgtccaacctgcctcagacggcgcgacaactgttcactgcgacagtggcccccaccatggactacgcatcgacggtgtggacgcacacgcgcgggatcaagcagcagcgatggttgaaccgggcacaaagaataggcgcgcaggcgatcacgggcgccttccgtacgacctctagcttcacacgtcgaaggactaaaggatcgataggccacactttcatggtttgtattcacactgaaaatcaaaatcactctagcttcacacgtcgaaggactaaaggatcgataggccacactttcatggtttgtattcacactgaaaatcaaaatgaagctcccaaaccccctacgcagccagccaccagggccgcctgtattggggaaatcgaggcgaaggacggcttaccctcagccgatcgctaataatcttatataactaacttttcttatttctaaataagtataattttagattaaactaaaataaactctaatatattaatacttctaatagtaataactacctttcctttctaacttaaagcttatagctataatatctaatataaatattctaatctcttaaggcctggttaatacttctaataagacccttaaagtaataataactattatctaaggtaatctaatatagctatttactgggatttgagtaagagcatacggggccggacccgaaagaaggtgaactatgcctgtatagggtgaagccagaggaaactctggggtgaggtggccgggctcgaccagacgaggaggatagtagcacagtggaaggcacaggcgaaacccgggcgaatgatcatctacgcacagacgattgcagaggtttaccctcttgcacgccacggtcagttcccgggccagttttgattttccgcaaaattcatttgtatgggaaatcaaaaaatgaatactatatctcctgatatttttggataagatttagggtagttatcacaggatgagtcttgtggtgataggtatgtatagtggtgatctatttgctagcctcgttgcagctagcctcgcggccacttgcaatttccccctttcacaatacaacgaaaaatttaagcatctggtgagatagaaatctggcagctgtcttggggggttgttattgaaaaggaagatcgaccgacccgggcataccgctggctgaccaacagtacatgtggtgtggcataaacgtgcattcatggccacttggcacgatccatatatactataagtgtaataacaattttatatgctagtgtaagtacaataagaactacagatattaaagaattaattgctaggtcaacttcaaccctgaataacttcacaactaatagcccaggcgggaagcaaattagataaaaagtatattcagccaaagggcaaaagaaccctgtatcagtatttattgtcactacctccccgagtcgggattgggtaatttgcgcgcctgctgccttccttgtatgtagtagccgtttctcaggctccttctccggggtcgagccctaaccctccgttacccgttgcaaccatgtttggccataattagatgtgaagagtagaggttgggagatttatggtgcactcgcttggttggtgcactcgcttatcacatacgttattctaaatcatcaatttacttaacccattttactttatatattaaatcatatttctttccgattttcaaaatgcgttttattaagactatcatctctcttttctccttcactcgatcgtcaaatatgggcctgggggcgaaagactaatcgaaccttctagtagctggtttccgccgaagtttccctcaggatagcagtattgaactcagcactttggccaatcatgtgagcacagtcgtcgcattttccctggctaagattagtggtggttgcaaccatagtaccatcggagagctgacgctctactggctacatgagctgctgttggtttaaaaataaactaacccagacttttgccttgaaagggacctttcgccacacggcgcaaagtgcgcctttgaaacggaacttccctatggcttaggatcgactaacccacgtccaacccctgttcacatggaacctttccccacttcggtccttcaagtttctgggtgtgctatgtagtacctttccattttctggtcgaaaattccaaaaagtgacaaaccacgcccaataaagaccgaatgctgtaatgcgcgtcactaattagatgacgagtcatttggctaccttaagagagtcatagttactcccgccgtttacccgcgcttggtcgaatggcttcgctttgacattcattgtcactttttggaattttcgaccagaaaatggaaaggtactacatagcacacccagacactctcaccatgatcatgcattgggagatggattacaaggacgccagagttctggcgcccggtctgtctctcgggaagcggctgcagggtagccagtctctctttacatcccgcacatctccttctccagtatcttaggcgatcacagcgcacccacaccaccacaaatccaaccacagcgaatgcacgccactgtaaattccaccacagcgtgcatgcacccccacaaatccaaccacagcacatgcacatcgccgggaaccaaacttcagcacatgcacctcactgggaatgccaccaaaataatattcttcatatttatttatatttatttttgtgtagcgctagcgcaagctatgctagcaagcataaaagactaactcttgcagacacatagtctagggagaatgtaatactttaagtttattttaaggctgtgcatatttgatagccagaagtataggcttaggaggaggaggctataactattgggggaaacaggtaccagagtcttaaaagcttccagaacctttctatcgttctctaagatgtgtattgtaactggatctaagcgccaaaatagttgacgtgctggcgatttatgaatgaatggatgaacaaggcttaggaggaggaggctataactattgggggaaacaggtaccagagtcttaaaagcttccagaacctttctatcgtgctctaagacggggataatgtgcagaaaacaacgggctggcgaaatctcataattcggattgtaattggagaagatgggcgaactccctgaatggcgatcgtagaccataatgcaacgtaggccactcaacatccttgacaaagtcagcagccatgtcgggatcggtgaagacgctctcgaggtcaatcgtcggtagcccgtcctctcctccctccatcctccccagctcagcctcaactgtgatccccttgcccctggctctgtccaccaccgatttgacgtatttgacattacttttgattttccgcaaaattcatttgtatgggaaatcaaaaaaatcgactcacggccaccaaaccgcgcgaccgatagaagcatgacgttgttagattccatcggactaagcgtcgattaggaaggaatggcacgcgtcggggagaagtaaacagactggctttgacgcggtttaatattgtgcccgggctacttttgattttccgcaaaattcattactataggaaatctaaaaaatcaactcacaaccaccaaaaccttcaaccgataccagtatcttaggcgatatagccttcagggtagcttagaagagatgggatggcgggtttacaaaagtcatgtatatcgggcgcgcggtttggtggccgtgagtcgatttttttgattgcgggtattcctacctgatctgaggtcaaccttggaaagttgggggtttaacggcaggggctcgtcgctctccgatgcggaagcgggtattcctacctgatctgaggtcaaccttggaaagttgggggtttaacggcaggggctcgtcgctctccgatgcgcgtaggttatgttgagtataggttatgtaaagtgtaggttatgttgagtataggttatgtaaagtataggttaggtggcgggtgttgtgtgtgaatatgctttggtggcattcccagtgaggtgcatgtgctgaagtttggttcccggcgatgtgcatgtctacggacctacgcatcggtagcggcggggaacgggctagctacaagcatacacaatccattgaaccaactcaaagcgccacccgcgcaaatgcacctcactgggaatgccaccaaagcatattcacacacaacacacgccacctaacctatactttacataacctatactaaacataacctggcgcccggggcaatcccgccgaagcaacagtaggtatgttcacatgggtttgggagttgtaaactcggtaatgatcccgccgctggatattccggcacctggatgtgggttttgcgcggcaacgcaactgaacgcggagacgacggcgggggccccaggcagagtgctcttttcttcttaacggtctatcaccctgaaatcggtttgtccggagctagggtttaatggccggaagagcccagcaccttccatcggcttgagccgatagtccctctaagaagccagcgtactgccaaagcaatacgggctagttagcaggttaaggattagacagtcagattccccttgtccgtaccagttctaagttggttgttaaccgtacgccggacggccgaagcctgctacgggcatcagcacccaggtgctggctgccgccggccggttgcccggctagtggctgcctgctcccgaggcgtcctcccaaaatctggcgcaagcccgagttgtaatttgtagaggatgtttctggcgacgtgccttccgagttccctggaacgggacgcgatagagggtgagagccccgtacggttggatgcctagcctctgtgaaactccttcgacgagtcgagtagtttgggaatgcaaataccccaattgtgcagctatttttacattttctaatggatggtggactaactttaagctacgaaataacctctcgagaagacgggtcacaagcatctaggatgccgtattttgccttcaggttgcgtacgagagtaaaccaaggtccgataacctttggatcttcgcatttggccctctgatagtcatatttccgaacccagcgcgtatgaagctctggttgccgcttgatgaagttggaggcccatctaggatgccgtattttgccttcaggttgcgtacgagagtaaaccaaggtccgataacctttggatcttcgcatttagccctctgatagtcatatttccgaacccgctttagaagacgtatacctcccatttagagcagcattcccaaactactcgactcgtcgaaggagtttcacagaggctatgcggtactagaagtgtgctgtagtatttcgcgtattgtaattttaaaacgagcggggtcaaatcctttgcagacgacttatctgtgcgaaacggtcctgtaagcagtagagtagccttgttgttacgatcttggatcccatctgcgaagatataaaggatcaaggttgcctgcctcttattccacccacttcgatcggattttccttgttttgtcttcgtgcctttgacctcgtacgtatagctatccagatattcaaaaggtataggcgtctcatcgatattgacgatacagccacgtcggaagcgtcgggttggtgacatcgcaatggtaattgagcttagtacgagaggaaccgctcattcagataattggtttttgcggctgtccgaccgggcagtgccgcgcaatggtaattgagcttagtacgagaggaaccgctcattcagataattggtttttgcggctgtccgaccgggcagtgcagcgaagctaccatctgctggataatggctgaacgcctctaagtcagaatccatgccagaaagcggtgataccacccgcaagctctctcctacgttcactttcattacgcgtaggggtttgacacccgaacactcgcatacgaagacgactccttggtcccatccagcgccggcgagagcagagctctccccagaccaggcatcctcagtacgacgtaccgcacgcggccgctttcgtgaggcatccagcgccggcgagagcagagctctccccagaccaggcatcctcagtacgacgtaccgcacgcggccgctttcgtgcgggtcgacgcccactatgaatcacccgccagcgaagccgaagccgtctagcctgtccaagtgaccactcagtgggaatccatcatagcgatttctcgctagaatgaaattgctagcacttcctgcaatgaaaatggactaattatcaaaatgtaggctctttcattccatgcacaacgtggttgcaaagccacagagctgatacgcccaataaagaccgcatgctgtaccaaatcacgcaaaagacattgctcgatccaatgcatcctctcattatcctctctccgagaacatcaggatcggtcggagatgcgccgaagctctctcctacgttcactttcattacgcgtaggggtttgacacccgcgccaggtcgtactcataaccgcagcaggtctccaaggtgaacagcctctggttgatagaacaatgtagataagggaagccggctggtggcggccaagcgttcatagcgacgtcgctttttgatccttcgatgtcggctcttcctatcataccgaagcagaattctgctccagcctggcatgaacatgcctgctggtgatccttacaacctcgatttgttccctggagcaacgatcgtttcgagtcaacttcttgttgaagaagctgtcaaagtacgtaaaggctacgaatatctcgactccatcagcctgaacgtcttggctactcccctgcccccttcctgacccgctctgcactgagccatatacccctaacaccctgctgctgctgctgccggaatagccctcgtgtgcttattatccccccttcctctccatcatctcgccctaaccctgttgcctgcctagccctggcacatacatcctagcgatacgactaccacaagagtgtgccggagtcgttcacgagttttcgcgtgtcacagtctctttgcccttcaacaatcggtataaggccctgccccacctgcttcactgctcctggcacctagcttctctcggttcttcctgtcttgaggacctcgtacggttggatgcctagcctctgtgaaactccttcgacgagtcgagtagtttgggaatgctgctctaaatgggaggtatacgacaaccagctaccctatacccggcgaactcaaaccaaatctgccgccgccacgcagcctcgggcagggtgagaggataaggagaggatgcattggatcgagcaatgtcttttgcgtgatttggtacagcatgcggtctttattgggcgtggtttgtcacaactatgccgactagggatcggacgatgttaaaaattgactcgttcggcaccttacgagaaatcaaagtgcttgggctcgagggggagtatggtcgcaaggctgaaacttaaagaaattgacggaagggcaccaccaggggtggagcctgcggcttaattcttaaaataataataataattattattatatagtataaataactatatataaataaatattagattaatattaaatctatattattcctaataaaaaccttgcttaccctcagcagatcgtaacaacaaggctactctactgcttacaggaccgtttcgcacagctaagtcgtctgcaaatgatttgaccccgcacccatccaccatgatggagtcgaatgcacactctagtgccagatccgcatcgctcggcttcaagcagtggtcgaggtgaacagacacagggaccgaagcggcgtgtgcaatgtcgaccgcgtacttgataaaggcagggccatggaagtgcaaggtccaggggatacgagagtaaaccaaggtccgataacctttggatcttcgcatttagccctctgatagtcatatttccgaacccagcgcatataaagctctggttgccgcttgataaagttggaggcccaattaactccaacagggggcgcgtcgcgtacgcgtaggaggatattggccatttcctcaacactacttaaaccataacgcaggtgtcctaaggggggctcatggagaacagaaatctccagtagaacaaaagggtaaaagtccccttgattttggcctcattttcttctggagcctcgccggcaattcgatcaggtagttgctaggtcaacattacccagttctagcactcggtgcgagccatctgcatttgaggctatcgagcaagtgtcacagatgcggatagcagctaagcctacatgctcaaggtgtcaaaaatcaagaaagagctctcaatctgtcaatcctcattgtgtctggacctggtgagtttccccgtgttgagtcaaattaagaaaatcaagaaagagctctcaatctgtcaatcctcattgtgtctggacctggtgagtttccccgtgttgagtcaaattacgccgcaggctccacccctggtggtgcccttccgtcaatttctttaagtttcagccttgcgaccatactccccctggagcttcccgtaagtgctgatcccactcgctagtcatggggtccatctacttggacacttaccaaaagccaagctcaacggttgatgtgacggagcaagctgtatctccttcccttaccgttgtcagcggaccccgcttccgtcaacggaatgattgccgtcatggagctcacagcaccgtaaattccaaaaagtgacaaaccacgcccaataaagaccgcatgctgtaccaaatcacgcaaaagacattgctcgatccactgcatcctctcattatcctctcaccctgcccgaggctgcgtggcggcggcagatttggtttgagttcgccgggtataggtctgcccgccttttctccattcaccctcgcccttttcctcttcctcttccacttcctctttagatctaccctcccccgctcattagtgtctccgctctccctgagcatccgcacttggattccgctattgcgggaatatgatttttattcaacgtgccacgtggggtcgagtctctccgtgtcgcttttgcaatcgtcatgcgctacatgtgtcgccgcaaaaatcactaagccagcgttgaacgcttggcacgagttagccgtcgtgcccgtaaatggttccaagagacacaaagttaacatgtctacaagacagtcggctaacatctctagccagtagagttgaatttagagtggagagctttccggccctgagtggtggtttccctcctctctgggccagtccggacgcctcactgagccattcaatcggtccatgtgaacatacctactgttgcttcggcgggattgccccgggcgcctcgtgtgccccggatcaggcgcccgcctagggaacttaattcttgttttattttggaatcttctgagtagtttttacaaataaataaaaactttcaacaacggatctcttgacataacctacactttacataacctatactcaacataacctacactttacataacctgcacctcacatgacctacactttacataacctacactttacataacctatactcaacataacctacactttacataacctgcacctcacatgacctacacttaacataacagaatgggctagcacacagaatgggctagcacacagaatgggctagcacacagaatgggctagcacacagaatgggctagcactagtgggccatttttggtaagcagaactggcgatgcgggatgaaccgaacgcgaggttaaggtgccagagtagacgcgcatcagacaccacaaaaggtgttagtacatccagacagttggacggtggccatggaagtcggaatccgctaaggactgttttttttacttattcaatgaagcggggctggatttacgtccaacttctggttttaaggtccttcgcgggccgacccgggttgaagacatgaagacaaaccatgaaagtgtggcctatcgatcctttagtccttcgacgtgtgaagctagaggtgccagaaaagttaccacagaggtcaaaggcaacacaaaagccaaagccaaaggcaccacacaggtcaaatgcagcatccaagccaaagccaaaggcagtacaaaagccaaaggcaaaggcaccacataggtcaaaggcaacacaaaagccaaagccaaaggcaccacacaggtcaaatcgcgacgggcacctgcaaaggcagcgccgacattgcccgcagcgctcagggcggagtgagcaagactggtcttgacaccttttttggggctgcgggtgacgagctcgtgcagctcgtcaaagtcgcgctcctcgaggtccccgagatcgcgacgggcactccgtagaagttcacaaggcagttgtcgttcgaagatgcgttgtctgagatcactgttccgactcgatcctctatcttccattcacgcacaactcgcccaagcgtcaccgccagattttccccgctgtacttcttcgttccatccgggtcatgctgttcaacgtaggtgaaagctgcctcggctagccactgtttgaacggcttattgactggtcggctcttcctatcataccgaagcagaattcggtaagcgttggattgttcacccactaatagggaacgtgagctggggttagaccgtcgtgagacaggttagttttaccctactgatgacctcgccgcaatggtaattgagcttagtacgagaggaaatcgaaagatgaaaagcactttgaaaagagggttaaaaagtacgtgaaattgttgaaagggaagcgttcatgaccagacttatttctttaagtttcagccttgcgaccatactccccctggagcccaagcactttgatttctcgtaaggtgccgaacgaggcaatttttaacatcgtccgatccctagtcggcatagtttatggttaagactacgacggtatctgatcgtcttcgatcccatttctttaagtttcagccttgcgaccatactccccctggagcccaagcactttgatttctcgtaaggtgccgaacgagccaatttttaacatcgtccgatccctagtcggcatagtttatggttaagactacgacggtatctgatcgtcttcgatcccaacaggccacaagccggaccccttccagcccgagcgaatattcgtatctgttagaccgatcaatcgagcctttgtataatactgaaggaaggtcatcttgctgattggtgatgaatcaattagaatatccttcttcgcaagctcctcgcgataggctctacctctatataatattattaaaaagagaataaaattctaatagaataataaatagtaagaagtattttataaaattaaaaactaaatacttttagaatctatactatagatatttaactctataagagaagtagaacttaaattaaatatattagattttataattagtatataagttagctaaaagaataataaagggagattataccctatagtattttatttaaagaaactatatagtatagaacttaattattctatttataataaggaatttatagttattatatatatatttaaagaatttacgttgatgaccattacgccagcatccttgcagagcgcgaacctcagtccaccccagggtattacacagtgggctataacacttattagattaaaaaccaatgcccttcggggctctctggtgattcatgataacttctcgaatcgcatggccttgcgccgctacaccggcccacatttaccctcttgcacgccacggtcagttcccgggccagttttgattttccgcaaaattcatttgtctgcttcttagataacctcttttcaagcccggacctctttagtgttctgagagatttgaaggttggggctacaggcacctgctgtacgaactgcggtatcttcaaaagcctcgtacagctgaaaaaggctgataataacggcctattgaagtggaattggggttaaatggaaacagaaaagtcatgtatatcggtcgcgcggtttggtggccgtgagtcgatttttttgatttcccatacaaatgacttttgcggaaaatcaaaagtggcccgggaaccgaccgtggcgtgcacgagggtaaatgtgggtcggtgcacctatgagagaattaccgaaacccattctctatcacctggctgagctaaggttagttttccatatctatccgagcttgtaacaaccatggtggttgagattatgcccattataaagccagtctcatcaaagttatccctcctcgtcatcgttggaatatggatgaagccggcattatggaaggaattggagataatagcctagttcttgggttatctcgcaagaactgggctgcccagatacagcccggcacgcgttattggactacgataattgaatgcataagtgcaacaatccctcctcgtcatcgttggaatatggatgaagccggcattatggaaggaattggagataatagcctagttcttgggtcatctcgcaagaactgggctgcccagctcagagggcttgtcgctgacgttgatagggagcggcattgctaggcggggatccaccatcatacggtcggcatttgtaaagggatccgtgaacccacatacgaagacgactccttggtccgtgtttcaagacgggtcgttgatgaccattacgccagcatccttgcagagcgcgaccctcagtccaccccagggtattacacagtgggctataacactcccgagggagccacattcccaaagcctttatcccccgaaaacagcctatggccgccaaattgagcatcttatgaaggcacggattacctatattacaaaggaagatttcttccctgtatttctagaagcatttaacagcagccgcggtaattccagctccaatagcgtatattaaagttgttgtggttaaaaagctcgtagttgaaccttgggctgtatgaagttagtcatggcaattgctagcctttgcaagaggcgcgagagtccttgccgccgcccatctcggcaaggtcggaagaacggttctaaatgttgacctagcaactacctgatcgaattgccggcgaggctccagaagaaaatgaggctctccctctcgttgaagataccaatacgtatggaagtgctgtagctgaagcggttgctcttgccgcataagtggctcgattacgtgagcgcaagggagcccaagcctgagtaatagcggagttagcagttgagagctataagttatagcgaacttccctgctgcgttatagcggtctcaaggcctaatacaccccttagagccaatccttatcccgaagttacggatctattttgccgacttcccttatctacattgttctatcaaccagatgctgttcaccttggagacctcctaatcattcgctttacctcataaaactgagttcaatactgctatcctgagggaaacttcggcggaaaccagctactataaggttcgattagtctttcgcccccatgcccatatttgacgatcgatttgcacgtcagaaccgctgcgagcctccaccaggtgcatggccgttcttagttggtggagtgatttgtctgcttaattgcgataacgaacgagaccttaacctgctaactatcccgtattgctttgaaaggctcgggaaggtgcgggggaagaagtcttcgtgcaggctgtctgcaaagtccgcgcctcgttctaccaagatgaacggctgccctcctgtagcttggacctgaatcgcattagatatttaattctataaaagagatagaacttaaaactaatactttagattttataattagtatataacttagctaaagggataataatagaatactatactctatagtattcttcttaaagaaactatatagtatagaacttaattactctatctataataaagaatttatagctattatataatgtcaatagatgtggtagaagtcgtcatttggcgagaaagctcagtctcaggaggaagcggagcagtccaaatgtgtttgagatggcatgttcgtcaagacccttgcaaatcttccggaatagcagtctcatcggtggatcgatgacctcgttattgataaaatcgcgaataatcttccggacctggtgactgcccttaggcgttgaaatatccggttcgtgatgatccttacgctttatcccggcctttggaggagttgagggaggagttgaaggtggccgaaagggcccaaacaccggcttcatcacatacgggctcatcaagggtttggccacgttaacaggccacaagccggatccctacaggctatccatacatattttggtgcagagccagtcaaagaggcacctgttgcgtctgtggctgctgattataacgatcatatgggtgctgtagatcagggtgaccagcttcgggcccaagagggattggaacaccgggacaggctatccatacatattttggtgcagagccagtcaaagaggcacctgttgcgtctgtggctgctgattataacgattatatgggtgccttcaacaacctgtatttcctcctcttcatcgtcgctaacgtcagggagaggctgcgttggcgggaaggcttcgaggtttatctctaatagctgctccttttttatcggcacagcctgctcccaaggcacgaatagggccagatggagaacagagttactggacggaaatgtgagaacaagcctcggggttagcagtgtaagctcagaagctccgccgacctcatgagtacgccgtgccgatttttcaaggatttatcagcgacgatcaccatgacgagcacccagtgtacttcagacggtatgctgattctgccagtagtcatatgcttgtctcaaagattaagccatgcatgtctaagtataagcaattatacggcgaaacttcgaatggctcattatatctctgtggtatattccggtgcctctatgtttccgggtatatattaatatagatggcacccgtcgacgacaactgctggcatcgtcctccactacgtgtaggggttcatgcgtgtgatagattccgcaaagtgtgaagcccgggggggtgggggacttttcgggaggcccaagacaatttcgatccctgaaatccctgaagccaggcaacaccaggcatttcgccctccataccaactgacataccccagccagccgaagtaaagctgcaatgtctcaagaactgggtgaggcatggcgcagtgaagctcggcacggcagcgggagggagggatgaactcctgtgggagattggaaatggtaatagtatggagagcacggaagctgagatttgaaatatttgaaatatttgaataaatatttcaaacaacaaatccgacgttctattattaggttatcaggcttatcaagcccagataagggtctagaaaatccgggaaaaatcctaggatattctcagacaacctaacctataccaagctaccctataaccagcctaccctagactaggtcttagatcttagataattccttcagctttaccagacagttggacggtggccatggaagtcggaatccgctaaggactgtgtaacaactcaccaaccgaatgtactagcccgagttggcacagaatagacgccgcaaggaccgcaatcgaggcgataagggagctttttttggactccccaaagacgggcccgtctatctcgtaggccgcattgccgagatagatagtatttgctatcgatgccgccgcagcaataacacacactatttcttgcgccgaaggaaggcgtttggattcacgatacgggtaatccaagaacacaacccccccatctgctttctttttcaacctatcctaattggggtatatatctaatagtgtttaaatatctactaggattattggttctacactaggacttggcatggtggcttgactgcatagcagattggtaggtcgggattttgtttcggtaggaatcaggttccaactgttcctttgacgaagacctcctttgtggccgtacattctgaggagatcgccagaaatctgctcccgccactcgtgtaagttccggagcggcttccaatttggctggccattcttctgcagtaagaaggtgttcgtaagagcggtctcaagaaggaagcccgagcggggtcaaatcctttgcagacgacttagctgtgcgaaacggtcctgtaagcagtagagtagccttgttgttacgatctgcgctgaagcttgctacatgtttccgtcgtcgtatctccccatgtgaggatagccacgtcgtcgataaacccagtggctgtagtatcttctgccaggctgcagctttcaataagatctgcattatagaaagtgtagagaatcggtgagagtggagagccttcaaatgtctcttcgtttgtcgatgccaggagctcatgccatttcccataaaagtccttccactcttggtggccttgaggttcttcaaatgtattgttatggcgcataaaacttggctgacagtaacgtagaactgccttgttggcatgccaaaggcatagaagcgacacgagcttgcattggaagctttgaaaggcagagagtgatgcatccctgttggactcaaaagagccatacttgatagcactcctggctatgcaagcagcagttatagctccctgggaggtacatagattgaacaactgctgttcctggttcactccctccgatgtctgggactcggaagcgttggatgcggtgcgataagaatagtgggcgtcgaccctcacgaaagcggccgcgtgcggtacgtcgtactgaggatgcctggtctggggagagctctgctctcgccggcgatagtgggcgtcgaccctcacgaaagcggccgcgtgcggtacgtcgtactgaggatgcctggtctggggagagctctgcgctcgccggcgctggatgggttctgtggatggatggccgctggctaaacttaccactgagcaacgggagatcgccacgtggggatcattaccgagtttacaactcccaaacccatgtgaacatacctactgttgcttcggcgggattgccccgggcgccccgtgtttgaagagacccgcgagttcgcccgtcgcgatgccgttgccgatgcctatgccgacgcgtacgcttcttactacaagcgtgccaccgtcctccaggcccgtgctggttgcgtaaggcctgctgccttccttggatgtagtagccgtttctcaggctccttctccggggtcgagccctaaccctccgttacccgtggcaaccatgtttggccaatacccaaacatcgaaagttgatagggaagaaatttgaatgaaccatcgccggcgcaaggcccaggtgcttgttggaagagagtctaacgtatcaggaagcgagcggctcaccccatcggggaggccccccgccgcctaccctttggcaggaaggctttcgtcagcatggtacttttaggatcaagtggaagatgcggacaatcatcgaggaacataatgagggggaaggtggattgccgtgcgcggcgtcggtggccctgccgctggtgctgtgttcggcgcgctctcacgagtgccattcagtagggggaaggtggattgccgtgcgcggcgtcggtggccctgccgctggtgctgtgttcggcgcgctctcacgagtgccatgcagtaactaattctccaaagttgggtctttcataaatggattctctactccataaatcgcttcagccgttgccagggtcataagctcacggagccatcgataagcgttaggcacgttaagaccttcccctccaatattattaatgcatgatccgatatacttgagtgcttcagcatggagtagtggtatttcaccggcgccgaagctcccacctattctacacctcctatgtcttttcacaatgtcaaactagaggcaagctcaacagggtcttctttccccgctgattctgccaagcccgttcccttggctgtggtttcgctagatagtagatacctcgatttccccaatacaggcggccctggtggctggctgcgtagggggtttgggagatggattacaaggacgccagaggtctggcgcccggtctgtctctcgggaagcggctgcagggtagccagtctatctttacatcccgcacatctccttctccaaacctacactttacataacctgcacctcacatgacctacactttacataacctgcacctcacataacctgcaccccacacgctatctcaccgcctgtagctcacgctcagtagaccggccctccctgtatctagccactgtcctcgacttacagcgcttaacctacactttacataacctgcacctcacatgacctacactttacataacctgcacctcacataacctgcaccccacatgctatctcaccgcctgtagctcacgctcagtagaccggccctccctgtatctagccactgtcctcgacttacagcgcttgctgtagtatttcgcgtattgtaattttaaaacgagcggggtcaaatcctttgcagacgacttagctgtgcgaaacggtgctgtaagcagtagagtagccttgttgttacgatctgctgagggtaagccgtccttcgcctcgatttccccaatacaggcaataggacgtgtggttctattttgttggtttctaggaccgccgtaatgattaatagggacagtcgggggcatcagtattaaattgtcagaggtgaaattcttggatttattgaagactaactactgcgaaagcatttgccaaggatgttttcattaatcgacaccgccatggttgaagctgtgcgctgagcactcctcttggggcgcccaagccgcaccggccctagtggtcttggtggggtggaaggatgccctggggaactgagagggggaaggtggattgccgtgcgcggcgtcggtggccctgccgctggtgcttgaagaggacccaggctcatgggagggcgtcccgcgggcgctgcagggtatgtaaaatcaaaaaagttgttaagagccgcggtaaatgaagctggtcctcgtgatcgacgaggttagcatgcttggaggcgctaccctgtatgaggccagctgccgcctccagtcgttcagagactgtcctgatcagccctttggcggtattcccgtcgttcttttgatgggggatttttatcaattcgccccagttcctaataaaaaccttctatagtagtaaatatatattatacttatagagataaattaactaataattttatataactaacttttcttatttctaaataagtataattttagattagccactgggtttatcgacgacgtggctatcctcacatggggagatacgacgacggaaacatgtagcaagcttcagcaggcactccgactggcagagcagtgggcgaaaagtcatgcatcgagcaatgtcttttgcgtgatttggtacagcatgcggtctttattgggcgtggtttgtcactttttggaattttcgcccagaaaatggaaaggtactacatagcacacccagacactctcaccatgatcatgcaagcacccggccagttacagggcacggagcccctgaattcggaccacttatcatccatgtcgtcaaaattgaagattgaactgaactgattcgcatactaatactaaatctataacttgacttcgatacactggcctacttcatcacttaccgagtataaggcttcctgttcctacgtccaagtgccttctcgtacccttccagtgctcggtcaaacatcgcctcagcctcactgagcttgccttgatccctatagacgagaccactcagtgggaatctgcaagatacggtacagttgaagagatttcccacagcggatcggaccagcttgttacagtttacccgagacgctgtgagtggtttaataaactttctaataattctattctatttaattcttttctatttaataatactaattaaaataaatatttatttattctccgttggtgaaccagcggagggatcattaccgagtttacaactcccaaacccatgtgaacatacctactgttgcttctgcgggattgccccgggcgcctcgtgtgccccggatcaggcgcccgcctaggaaacttaattcttgttttattttggaatgcttgaaatctgaactgctggctaaccaccagcaaccttctaagtgtatagttagaatcgaaatgtgggacttacattaattaggctccagatctccaagtaagagggccgaggtaactattattagtaagacgagatgtggagaggatgtttgtgaaagtgtcggggggcatgagcgtgtcgcgcccacaccaagccgacgacgaggcagccgagaggcggcagtaccgcgcccgcggcggagtcaacatctacgccctgccctccgaggcccgcacgtggagcctgatccgtgagtacttccagaagaccggacagctgctgccattcatccacgaggagtggttctgcgccaccctgctcgtcttgatggctctgattctggcctcactcgccgtgaaatggctgaagcagcccatgaggaatacctcgcagctcgcgatgaatatattgagaagcgtgacctcttccagcgtgtaagcattcatgattaccctatttaatatatcctactaagagggggaaggtggattgccgtgcgcggcgtcggtggccctgccgctggtgctgtgttcggcgcgctctcacgagtgccatgaaagttgatagggaagaaatttgaatgaaccatcgccggcgcaaggccatgcgattcgagaagttatcatgaatcacccgagagccccgaagggcattggtttttaatctaataaatacatcccttccgaagtcgggattttaagcatgtattagctcctttacataacctgcacctcacatgacctacactttacataacctgcacctcacataacctgcaccccacaggctatctcgttgtatgacttccgtggccatcaaggataagtaacctaggtctcttggtctcgggcttcgtcaacgggatgaagatcaggtcaagccatactattccaggcatttgtgcctctttatctagctaatttgtgggctagctacacaaattacgaccttccagctgatcaggtaggtagctaagccgggctcgcaacacacctttaaaaacagatctcttagagccacaccaacacattcgaaagtgagctaatagtaaagacggctaggctatcacttccaaccaggtatatctcttgcccgctcaccacaatcctcaagtccacaacccaggacccaactccctgcctcaccctgaccatcaagctcctctcccccccccccccccccccccccccccccccccccccccccccccccccccccccccccccccccccccccccccccactgccagtatcagagctagatggctctacaactatctgacaagtccgtgcattatgtcctgtcttaccacatataccacatcgtcgaacacgggtcttatcactgccagtatcagagctagatggctctacaactatctgacaagtccgtgcattatgtcctgtcttaccacatataccatatcgtcgaacacgggtcttatcccgtggcttccgaccccgacccaagtgctcttcctgggtaatctgactattaacctcattcatgataacttctcgaatcgcatggccttgcgccggcgatggttcattcaaatttcttccctatcaactttcgatggttgggtattggccaaacatggttgcaacgggtaacggagggttagggctcgaccccggagaaggagcctgagaaacggctatgtgatgaagccggtgtttgggcccttccggccaccttcaactcctccctcaactcctccaaaggccgggataaagcataaagatcatcacaaaccggatatttcaacgcccaagggcagtcaccaggtccggaagatcattcgcgattttatcgattatctttgtactctcgtgacgggtcatcgatgagagactcgtcagattgcttccatcggcctccagttatctgctgcttgacatcaataagagcgtttctggtcccggttcccccaaggggaggtaggtcggttccaaggggtgtatcctctcttggctaacctcccagtccttccccaatgattactccccttcaacccccaaatctcgacccgcctgccactcactccatccaatgcttctgtcaatccactttctctcgtccttcccgccctggtctccatccattcatctcttcctcgacctgtttttgtaactccccctggagcccaagcactttgatttctcgtaaggtgccgaacgagtcaatttttaacatcgtccgatccctagttagtagagtaaaactaacctgtctcacgacggtctaaacccagctcacgttccctattagtgggtgaacaatccaacgcttaccgaagtgcgcctttgaaacggaacttccctatggcttaggatcgactaacccacgtccaaccgctgttcacatggaacctttcggctccttctccggggtcgagccctaaccctccgttacccgttgcaaccatgtttggccaatacccaaacatcgaaagttgccctacagtctatcttcttagctaccctgtagctgataaagtctcttttccttactaagtaggctgcttcttccactacacctttcgaaacaatcccttcagtattccttagcctaccctataggctgtacctaccctagacccagcttaccctacagttttggaatcttctgagtagtttttacaaataaataaaaactttcaacaacggatctcttggttctggcatcgatgaagaacgttataaaccttatactatagttctttatatatttctactagtagttctttatatatatatttaatagggtattcttctagatcttttttaaaaatagtatatagttctattctatattattaatatataaagtatattatttaaatatctttaagtttaatagatatctttctattagcgaacgagaccttaacctgctaactagcccgtattgctttggcagtacgctggcttcttagagggactatcggctcaagccgatctcacgccaggtcgtactcataaccgcagcaggtctccaaggtgaacagcctctggttgatagaacaatgtagataagcgaagtcaatactactataaaataagtactaaaataatcttttatttaattgtaacatctaaatagaatttaataggaataatattattcatatttatttatatttatttttgtgtagcgctagcgcaagctatgctagcaagcataaaagactaacccttgcagaaatactactataaaataagtactaaaataatcttttatttaattgtaacatctaaatagaatttaataggaataatatttttcatatttatttatatttatttttgtgtagcgctagcgcaagctatgctagcaagcataaaagactaacccttgcagactgatcagctggaaggtcgtaatttgtgtagctagcccacaaattagctagataaagaggcacaaatgcctggaatagtgacaagggcgttgacggcagctgcataatgtgtggtttgcgaggagggccaattaggaaggccttcgacgtgtgaagctagaggtgccagaaaagttaccacagggataactggcttgtggcggccaagcgttcatagcgccgtcgctttttgatccttcgatgtcggctcttcctatcataccgaagcagaattcggtaagcgttggattgttcacccaatttttaacatcgtccgatccctagtcggcatagtttatggttaagactacgacggtatctgatcgtcttcgatcccctaatttttaacatcgtccgatccctagtcggcatagtttatggttaagactacgacggtatctgatcgtcttcgatcccctcactttcgttcctgattaatgaaaacatccttggcaaatgctttcgcagtagttagtcttcaataaatccaagaatttcaagagctatcgtcaggtcatcttctgagacagttatttcctcgtcatcacacagctgatcgacgatttcgtaggcgttgacgacagcttgttcagctagagctatcgtcaggtcatcttctgagacagttatttcctcgtcatcacacagctgatcgacgatttcgtaggcgttgatgacagcttgttcagctttttcccagttgctgaagtcgatagcttctgcaggcacgtctttgatacggattttatcatcctggatggcgctcaagcgtctcacccatacctcgccctcagggtagaaacgatgccctgaggagtaggcggacgtggaggttgacggaagaggagagtagaaaacttcgagaggaaaaggcgagagacgaagcggaaaggcaaggggggctgcgagttgattttggtgccgaattagaagatgagcatgatctcgatggaatgttatgaaatgtctctatgttgaaatgtctatatgcaaaggctgaaacttaaagaaattgacggaagggcaccaccaggggtggagcctgcggcttaatttgactcaacacggggaaaaggctgaaacttaaagaaattgacggaagggcaccaccaggggtggagcctgcggcttaatttgactcaacacggggacactcaccaggtccagacacaatgaggattgacagattgagagctctttcttgattttgtgggtggtggtgcatggccgtaaggctgaaacttaaagaaattgacggaagggcaccaccaggggtggagcctgcggcttaatttgactcaacacggggagactattaatttctttcttggtttagtagcctctttagttattattttatattatccttaaatatataattttttttaaataactattaataacgtagcttaatcttagtcctaattaaatatactattagcgactatgtggtttaaacttctatatttttctggcaaggtatcgaaagggtctgagttgttcatgtccaataattcactggagtatattggcagtggatgcctatgagagttcactcctctgcggcccagtatagggagaattggcgggtaaacggcgggagtaactatgactctcttaaggtagccaaatgcctcgtcatctaattagtgacgcgcatgaatggagtaacgagattcccactgtccctatctactatctagcgaaaccacagccaagggaacgggcttggcagaatcagcggggacccagctcacgttccctattagtgggtgaacaatccaacgcttaccgaattctgcttcggtatgataggaagagccgacatcgtactttacataacctatactcaacataacctacactttacataacctatactcaacataacctacactttacataacctgcgttatcttccctggaatggtggttactacctcagagggtcgtacgaaggctaagctagtccagcctggtaaccgggagtaggcaactgtgatccaaggggtaaatacagctggctgggctatccttgcggaaaatcaaaactggcccgggaactgaccgtggcgtgcaagagggtaaatgtgggccggtgtatttctgaagaggacccaggctcatgggagggcgtcccgcgggcgctgcagggggggcggcacagctgttaaaccataacgcaggtgtcctaaggggggctcatggagaacagaaatctccagtagaacaaaagggtaaaagtctactcaactgatcagcttaagagcctctttcagataaaagtaggtcttataaaagctatatatatcggtcgaaggttttggtggttgtgagtcgattttttagatttcccatagtaatgaactatatattaagtatatctatataatactaatagtaatatattctatatctaatatattaccttcctatatatatatatatttattttattaaatagaatactctcttagtagttattaatataattatctatatatctattattactagctctataatatttatatattaatagtaatttatatacgccacagactgtgtacgaggcaagcgcacagtctgagcatattaaatcccgaatctcagctcatcaaaatagctctctaacctctatgctggctgcaatagatcaatttacaaagggggcaactgcagtaatacaccaggtggctcttttgcgtgctgaggtccgggatcttcgtacgggccggtgtatttctgaagagtacccaggctcatgggagggcgtcccgcgggcgctgcagggtatgtaaaatcaaaaaagttatagcagtattgaactcagttttatgaggtaaagcgaatgattagggacccgggggctatatattgccttcatccattcccaaactttaatagcagtattgaactcagttttatgaggtaaagcgaatgattagggacccgggggctatatattgccttcatccattcgcaaactttaatagtaaccaccattccagggaagataacccccatcataaagccggtctcgtcaaagttgtataggtcctcatctaggataccgtattttgtatctagccactgtcctcgacttacagcgcttcccaccctctaaaacaataatttaccgcggctcttaacaacttttttgtatctagccactgtcctcgacttacagcgcttcccaccctctaaaacaataatttaccgcggctcttaacaacttttttcagatttaaattgtactcattccaattacaagatccaaaagaaccctgtatcagtatttattgtcactacctccccgagtcggatttaaattgtactcattccaattacaagatccaaaagaaccctgtatcagtatttattgtcactacctccccgagtcttgatctttctctaccttattcctttgtcttaaatcacaaaaacactaacttcgccttcaattcttcaaaatgcgcatcaccgccatcatctctatcttcgccctctccaccgttgctgctgcgcagcacgtcgaacttggggagcgtgagcttgaagagacccgcgagttcgcccgtcgcgatgcgccctgaggagtaggcggacgtggaggtcagtgacgaagcctagggcgtgagcccgggttgaacggcctctagtgcagagcttggtggtagtagcaaatacttcaatgagaacttgaaggaccgaagtggggaaaggttccatgtgaacagcggttggacggcgcgctctcacgagtgccattcagtaactaattctccagtgcccctcgtgggcgctggtggccaaccccggcgaacgatagttacacttcatcgactggctaatcggttatggatgatcacataacaaaaatacaaggcctttttcttcaagttgaatgaataatgaatttatagtccgcacagccaataatgcagccttaacaacagaaccagtgattcatagtggaagagataaggcttcttttgccagccattctccttttcaagtttcagggtgaagatgaatggtaaagttcggcataaccgtcaaaaagcatgcaatcactgccgtggtatgactactataacttagaagagaattcctcctctattaatactaaaccatttaaactaatacattttatagatcttatttagttctacctataggctagctttcgagactgtgtgttctgacgtaggtaggacctgatctctttcggcgctaccccagcattcgcaaggttgttgatagttgacctatcactgttccacggtttcgtttgctgcttttccaagctcacttccttcccccatcgtgggcgtactgttgaacggacctggtactctttttccctgtccaggtggcatcctacggatacgtgcgctatgctctttattacgtcctccttcctcagcgtctagggactgcaggaccgaagcaaaccagacgtaagcctaataacctcccaagcttggatgccgtactctttccatgtctgttacgcccttttcatatgttgttcaacattccttgcagagcgcgaacctcagtccaccccagggtattacacagtgggctataacactcccgagggagccacattcccagagctcgcgaagctgattattctgaccaccacttcaaaaaaagtcatgtatatcggtcgcgcggtttggtggccgtgagccgatttttttgatttcccatacaaatgaattttgcggaaaatcaaaacaccatgatcatgcaagcacccggccagttacagggcacctaccctactaaaacaacccacaacagtatacataagcaactttatatggggattcatagggagacacgatattctgactactggaaggctccccaagccggtcagcagcttccggtccatccaatagtcggtcgcgcggtttggtggccgtgagtcgatttttttgatttcccatacaaatgaattttgcggaaaatcaaaactgggccgggaactgacccaggttagttttaccctactgatgacctcgccgcaatggtaattgagcttagtacgagaggaaccgctcattcagataagtggtttttgcggctgtccgaccgggcagtgccgcgaagctaccatctgctggataatggctgaacgcctctaagtcagaatcttcgcgcgtgcatagaaccgataaatacaatggcatgtcatgtcctgcctacacaagtacaagagaccaatgcgtaatagctccactcatcctcgctatcctgtatctccacctccctctcgctctcctgtacctctgtgtcattccccccatcccgtgcctcagtgtccggcctgatggcaaacgcagcagggaagttcgctataacttacagctctcaactgctaactccgctattactcagtgagttttagtgctagatggaagcgccttaggctttcgccttcagcactcgcgcccctctctcataggtgcaccgacccacatttaccctcgtgcacgccaagcgccttaggctttcgccttcagcactcgcgcccctctctcataggtgcaccgacccacatttaccctcgtgcacgccccggtcggttcccgggccacttttgattttccgcaaaattcatttgtatgggaaatcaaaaaaatcgactcacggccaccgggaaaggcccggccggaccagtacacgcggtgaggcggaccggccagccaggcccaaggttcaactacgagctttttaaccacgggttagtcgatcctaagccatagggaagttccgtttcaaaggcgcactttgcgccgtgtggcgaaagggaagccggtcaaggcgatgcgggatgaaccgaacgcgaggttaaggtgccagagtagacgctcatcagacaccacaaaaggtgttagtacatccagaggcgatgcgggatgaaccgaacgcgaggttaaggtgccagagtagacgctcatcagacaccacaaaaggtgttagtacagccagacagttggacggtggccatggaagtcggaatccgctaaggactgtgtaacaactcaccaaccgaatgtactagccttgagtcgatccagctactgaagaactgggtcaggggagggtgtgttactcttggaggcctatgctcgagtaataaggccagttagaactcgagggtaggatcgcgaggccgagggggagcttcacatgagatcagcacgacggagtttaacaagattacccaggcctttcggccaagggagtactcgctggctccgtcagtgtagcgcgcgggcggcccagaacatctaagggcatcacagacctgttattgcctcaaacttccatcggcttgagccgatagtccctctaacgtctcgcgatcaatattatcacgtaccaaaagggcgatatcccacgtaatagctacagacgaacttgctaggccgggttatccaacctcttccttaatgagggatcgcgagaggccagccgcggagtctcttcgcaaagcggttaatgtacactttacataacctgcacctcacataacctgcaccccacaggctatctcaccgcctgtagctcacgctcagtagacccgccctccctgtatctagccactgtcctcgacttacagcgcttcccaccctctaaaacaataatttaccgcggctcttaaaaacgaagggtatctttactcacctgacgttactgttgaattcaacgatacagcttataataatgaggaattattcagacattggatagcaaatgaattagctgtaattctggatggcaaggaacacatgttggtcatggatgtagccagcttcaggctgaaacttaaagaaattgacggaagggcaccaccaggggtggagcctgcggcttaatttgactcaacacggggaaactcaccaggcggtgagatagcctgtggggtgcaggttatgtgaggtgcaggttatgtaaagtgtaggtcatgtgaggtgcaggttaggtaaagtgtaggttatgttgagtataggttatgtaaagtgtaggttatgttgagtataggttatgtaaagtataggttaggcattgcctattcacgatgagttagtttgcagtcattgcaacagccagtctctacaatttcttgtagagacagagtgaccactcacccatatttgcacggtcgatgaagcagaaaagatagagcagggctacgattggcacgatgtagaggtcgatcttgttgcgaagatgcctctcggtcgtttagaaataagaaaagttagttatataaagttattagttaatttatctctataagtataatatatatttactactataaaaggtttttattaggaataatatagatttgtcggcggtaatggcaaaccttcccctttcttaattgttgaacctgaaatggataaggagctgggccttaaggaagtacaatctatgatccgatggcttgacctttctcaccgtggtaagatagtcgtgcatatggacctctgcatgaataaaagtcttggtcttcctatcgaagatctgtttacggatctccgattcgagcccgtatttctgaagctcagcaatatacctccacgtccgcctactcctcagggcatcgtttctaccctgagggcgaggtatgggtgagacgcttgagcgccatcccttttcaacttctagtaccgtagagtaatcgcctgctaagacgctaagccgaagcctattcttgtccatctgtacgtgcgggtggtctcaccgctttctggcatggattctgacttagaggcgttcagccattatccagcagatggtagcttcgcggcactgcccgctgaggagtaggcggacgtggaggtcagtgacgaagcctagggcgtgagcccgggttgaacggcctctagtgcagatctcggtggtacgaagcctctggttgtgctatgctcgcgatccacgcgcctcgtgctctttgggacttgtagctctccgcgtttgggtcacttgtggctatttgtaacgcgttggcttggcctttttgcacgaacttgatagttgtgccgtggagggatatccttccgccgttgaactccaggtcagttccctctgcaagttggatttccggacttagtttagttgggatgtggccggctagaaatggggtgtgcgtaagtcgccacctagtcaatcgcccaccttgtcagtcccaacctctctcttttccttacgcgtcactccgcgattgctcgtgtaattttcgttcatccaaccacagcacatgcacatcgccgggaaccaaacttcagcacatgcacctcactgggaatgccaccaaagcatatccacacacaacacacgccacctaacctatactttacataacctatactcaacataacctacactttacataacctatacttatagccttcagggtagcttagaagagatgggatggcgggtttacaaaagtcatgtatctcggtcgcgcggtttggtggccgtgagtcgatttttttgatttcccatacaaatgaattttgcggaaaatcaaaagcatcgaagttcagacaccgacgcacagggtcctcggatgctcgtcgatgttgacaagacatctagcttcacggaactaagacgagtttccgcgcagaactacaccctcaacactctgcagacattggctcttcaacttgtgtgcgggttcctggatagatacgcaacggaccccgactcggtgctgaacacagactccggtatctttgctgcaaacaactttgcctgttccttgatctcttcattctctgcctgtctcttgattttttcatcatggcctccttgttgactaacatttccatgatcgagttcgggttgtttgaacatgaagcgatagatctcgcataactgtgttagagttcttcattatttttcattcattcttttttttttatttcttttatttattagtatattaatatattataaaaatgttgggtagtaataaaggattattgtgtattatgcataaacactcaccttatagtcgttgaacgttttgtaggcggacgtggaggtcagtgacgaagcctagggcgtgagcccgggttgaacggcctctagtgcagatcttggtggtcgtagcaaatacttcaatgagaacttgaaggaccgaagtggggaaaggttccatgtgaacagcggttggacgtcagtggttacgaggttcgctaactaagtgctaaggttctcgtacagcggacacgaggtccgctaatgcaagcgctacagtggacacgaggtccgctaatgcaagcgctacagcggacacgagtaaggtactatcaaataaacgataacttatataatgagccattcgcagtttcgccgtataattgcttatacttagacatgcatagtaaggtactatcaaataaacgataacttatataatgagccattcgcagtttcgccgtataattgcttatacttagacctgcatggcttaatctttgagacaagcatatgactactggcagaatcaaccaggtaactatcgttcgccggggttggccattgaacaaagctacccggagggaacagtcatgagaatcataaagccgctgtatggaatagccgaatcgggcgtgcattggtatgccacataccacaagcacttatatccaaacctgcagggaggctggagaggaatctgataaatcaatttctagtattattattgtagataattagctgttattatttgtcatgtatatcggtcgcgcggtttggtggccgtgagtcgatttttttgatttcccatacaaatgaattttgcggaaaaccaaaagtggcccgggaaccgaccgtggcgtgcacgagtaaagatcatcacaaaccggatatttcaacgcccaagggcagtcaccaggtccggaagatcattcgcgattttatcgatgacaaggtcatcgatcatgaggtcttccaacacctcttcgcttgcattatcgggaaggcgccacttgggatacaagttcatgtgcggaggctggacgctgaactcattgtctgtccgccgctgtaaactctgcgccattgacaaccttcaagccagtgtacatattcttgttgacaaccacaggcatcccctgagcatagaagaagatgcccgggaccttgctctaacttcttactatgaagagatatcggagcgatatcttcaaggtgatacaattgaagctattcacactgatattaataactgccttcagcaacggtgtcttccaacggtatcaatacgtacattctacagccagcttcaagaatggcatttagatgtgcacctctgctgggtctggtgcgctctcgacgtcccttgaaaatccgcgggaaggaataattctcacgccaggtcgtacgcataaccgcagcaggtctcttcatacggccggcccccacgacttctggcgacgaaccctccctacgctggcccagagtgagcccctgatccggcacgcgatcaccgcgctgggtaccacccattggctcttcatgggccacgaatttgcgacgccgagccaaatcgccgcttccgaagctaaattcaacatggatcgcaggatgctgcagcacatgggcatcagtagcatcgagacgtgtatcacctcggccatggtggtcatctccatgattcatacggtaatcatgtccagtggttggaccgacctattttcctccataagagcggtagtcaacctttcaggtccatagaaggactcgttgatagaacttctcatcccgccatgagggaatatcacatatcgagggtaggagtagtttaaaatagggtagtattttaacacatggacaaggctcgccgtataattgcttatacttagacatgcatggcttaatctttgagacaagcatatgactactggcagaatcaaccaggtaactatcgttcgtgagtggtttgctgcagcgccttaggctttcgccttcagcactcgcgcccctctctcataggtgcaccgacccacatttaccgatggcggcagagtctccgagaggctcaacggcgaagtcagaggcacgaccagcgtcagacgccgacagcaacagcaggtcaagaagctggggaccctgctcaaagtactacgaacgtcacgtccgacagaggcaatgtaggtcacctaacctatacccaggctaccctataaccagcctaccctagactaggtcttagatcttgaataattccttcagctttattcgtcactgacctccacgtccgcctactcctcagggcatcgtttctaccctgagggcgaggtatgggtgagacgcttgggcgccatccattttcagggctagtacattcggttggtgagttgttacacagtccttagcggattccgacttccatggccccctaaatctagtggcggacccgtcgtggcctcctctgcgaagtagtgatattccgcatcggagagcgacgagcccctgacgttaaacccccaactttccaaggttgacctcagatcaggtaggaatacccgctgaacttaagcatatcaataagcggatgcacgtcagaaccgctgcgagcctccaccagagtttcctctggcttcaccctatacaggcatagttcaccttctttcggggcactcgcgcccctctctcataggtgcaccgacccacatttaccctcgtgcacgccacggtcggttcccgggccacttttggaaactcaccaggtccagacacaatgaggattgacagattgagagctctttcttgattttgtgggtggtggtgcatggcggttctaaagaaattgacggaagggcaccaccaggggtggagcctgcggcttaatttgactcaacacggggaaactcaccaggtgtggaacgggacgccatagagggtgagagccccgtacggttggatgcctagcctctgtgaaactccttcgacgagtcgaggagtttgggaatgctgctctaaatgggaggtatacgtcttctaaagctaaataccggccagagaccgatagcgcacaagtcactgaattctgcaattcacattacttatcgcatttcgctgcgttcttcatcgatgccagaaccaagagatccgttgtttaaagtttttatttatttgtaaaaactactcagaagattccaaaataaaacaagaattaagtttcctaggcgggcgcctggttgaaccttgggcctggctggccggtccgcctcaccgcgtgtactggtccggccgggcctttccctctgtggaaccctctgcccttcactgggtgtagcggggaaacaggacttttactttgaaaaaattagagtgctccaggcaggcctttgctcgaacctggacagggaaaaagagcaccaggtccgttcaacagtacgcccacgatgggggaaggaagtgagcttggaaaagcagcaaacgaaaccttacagcgcttcccaccctctaaaacaataatttaccgcggctcttaacaacttttttgattttacataccctgcagcgcccttattttactagtaatccccttactaattgagtcccgggctctctaggtcaaccaaatcgcttggaaggataacgccttagtcttgatgatgactaccgtttacaccggccaagagcttgtcgtaaagcttcgcaagagaccgacaactacgaaagcaagacatgcatggcttaatctttgagacaagcatatgactactggcagaatcaaccaggtaactatcgttcgccggggttgcccaccaggaaaatcaaaagtggcccgggaaccgaccgtggcgtgcacgagggtaaatgtgggtcggtgcacctatgagagaggggggcgagtgctgaaggcgaaagcctaaggcgctgcagcaaaccactcacagcgtctcgggtcaactgtaacaagctggtcctgatgataccgcctagccagccaactcaggagcctccctggatggcacaactggtggaacctgtgaagcagcctgagcatcacctcacgatggagtacatggtccactcggaacctgattgagtttctaattcagcgataccattggatagtgatggtggacgagcatccgaggaccctgtgcgtcggtgtctgaacttcgatgcagcagcggaatctgaatctccgtatcatagttatgggcaagcacgtcgtccatatcggcgttgggcgtggtttgtgcgccaccctgtggacctgtctcaatctcatctagcataaacccacatccaggtgccggaatattgaccggcttccctttcgccacacggcgcaaagtgcgcctttgaaacggaactcccctatggcttaggatcgactaacccacgtccaaccgctgttcacatggaacctttccccacttcggtccttcaagttctcatagacgatataatactatgttaatgcgtcgtttggctcatctaacctccaatgcaactaagatctccaagcacaagtatccgagcttccaagctgagctttccgggagcgccaatggggtagcagcacatctcagcctgatttatcagctctcgtgcattccacataaaatccgaggctcaaccgtaataaatatattgtaaagatccatcccagacatgcaagtatcgcattcctcaatgatcttctgtagtaatatccaagcccgttcccttggctgtggtttcgctagatagtagatagggacagtgggaatctcgttaatccattcatgcgcggcactaattagatgttctagaaacctttattcgtgaaggtgctatggtcttaggccttgatctacaggctaaagacggtctggttgatggctttaacgacaagcaggcctaccagatacaggccaatgttgctgcggaggattcttggaagagagctgtaagtgtattcattgcagcgtctatcgcgaagagagtcagagcgaccatcttgggctgggaagtgtttgttcaaatggttgcagtgagttttttttttttttctttgtgaatgatagtgcggtgttgaagaggaggaaaaacgcgtagcaggaaaaagggcgggtttcgtttacccgcgcttggtcgaatggcttcgctttgacattcagagcactgggcagaaatcacattgcgtcaacaccactgtctggccatcgcaatgctatgttttaattagacagtcagattccccttgtccgtaccagttctaagttggttgttaacctatttccgaacccagcgcgtatgaagctctggttgccgcttgatgaagttggaggcccaattaactccaacagggggcgcgtcgcgtacgcgtaggaggatattggccatttcctcaacactacgagttctcttttcttcttaacggtctatcaccctgaaatcggtttgtccggagctagggtttaatggccggaagagccccgcacctctgctgggtctggtgcgctctcgacgtcccttgaaaatccgcgggaaggaataattctcacgccaggtcgtacgaaccgctgcgagcctccaccagagtttcctctggcttcaccctatacaggcatagttcaccttctttcgggtccggccccggattaatgaaaacatccttggcaaatgctttcgcagtagttagtcttcaataaatccaagaatttcacctctgacaattggcgtgcatgcaccaccacaaatccaaccacagcacatgcacatcgccgggaaccaaacttcagcacatgcacctcactgagagcgtgcatgcaccaccacaaatccaaccacagcacatgcacatcgccgggaaccaaacttcagcacatgcacctcactgcgaatgccaccaaagcatattcacacacaacacacgccacctaacctatactttacataacctatactcaacataacctagtggtgcatgcacgctgtggtggaatttacagtggcgtgcattcgctgtggttggatttgtggtggtgtgggtgcgctgtgaagggcatcacagacctgttattgcctcaaacttccatcggcttgagccgatagtccctctaagaagccagcgtactgcaaaagcaatacgggctagttagcaggttaaggtctcgttcgttatcgcaattaagcagacaaatcactccaccaactaagcggtagcgatgccgcatgagagttggtcaaagccacaagtaattttgatactgaagcctccatttgcagccagcggctcactgtagggttttggcatcggaatcccgcactgcgttgtgcagagtatggagcaccgctgcaaaactctggtgatgctcagccgttgtcgcaggcaagttattgtcgtcgcgctcatcaagggggaattctgcatcgactgtgtcgtcgccttctgatcggttggcccagagcttgttatcttccctggaatggtggttactacctcagagggtcgtacaaaggctaagctagtccagcctggtaaccgggagtaggcaactgtgatccaagtatccgggctaaggtagatgatacagctggtaagaacctgtggcattggggaaggttgcgaggcgtggctacgccggatagtcttgtgagagctatccctacttattttactagtaatccccttactggtcgaaagagcccttgtaagagcccctcgggctataaggtcggaaggcgtgatatagctgttcaaaggtctcgtggctcataaattgtgcaatagggtggattggcttcatatcacccggcttggaagtactccaatggtctcggacacgcttttcagtgtgcaggctccacccctggtggtgcccttccgtcaatttctttaagtttcagccttgcgaccatactccccctggagcccacgcactttgatttctcgtaaggtgccgaacgagtcaatttttaacatcgtccgatccctagtcggcatagtttatggttaccaacagatacagctacctttgtggactttgtcgagcaactactacaccactgtggggagtggcccgaaccggaatctgcgctcgttatggataacgccagcattcactgttccgatgagatcaagcaattgtgtgataaggcaggtgtgaggttggaaccaacagatacagctacctttgtggactttgtcgagcaactactacaccactgtggggagtggcccgaaccggaatctgtgctcgttatggataacgccagcattcactgttccgatgagatcaagcaattgtgtgataaggcaggtgtgaggttggaatgcaccaccacccacaaaatcaagaaagagctctcaatctgtcaatcctcattgtgtctggacctggtgagtttccccgcgttagcagggagacattagggcgttcttggtccatccagaggtggagaagtggctacccgaggccgacatgttgaggggggacgactggaggctcttggcagaaatcaagcatatctatttccttatatagaataaagtatctatactttataagtctattaataactattagaatactattatattctactctagtttgacgaggcatttggctaccttaagagagtcatagttactcccgccgtttacccgcgcttggtcgaatggcttcgcttttacattcagagcactgggcagaaatcacattgcggtctactggagatttctgttctccatgagccccccttaggacacctgcgttatggtttaacagatgtgccgccccagccacaatggtgtcttgactggaagcagatgggtaagcattgtaagatacagggaggccttagagactggactaaggaagagacgatggcatatctagattggagcaaggcagaagatgatcgggtcgaggctcaggtcgcggccgagatggaaggcaaccctttctctagtagtacaatacgcgaaatactacagcacacttctagtaccgtagagtaatcgcctgctaagacgctaagccgaagcctattcttctggtttacagcggtttggttggcaactagcaactgtaaagcaggtatctcgtagttagggttcgtaaagtcatctattgacctctgagcctccttcaagcagagatgcttatctgctacgtacgggcgcaagcgtcgtccttattgacactttgggacgactttgtttcaggggccgcggtaaaaaatataaaacgagctttatttctgagcctccgtcacgtatgttattgacgcgtacttcgtgtgtcactaatatttccttgcattgttagaccctaacgctcatctcagaagtaatagactaagtagatatagctactggatctataatattaaaagcagctttattactataagtaggcccttaactaaccggaggggtatataataaatataatcactcccgccttccacgcggatcggagggaagtgagaaggccagtatttcaaagagctcgcgaagctgattattctgaccaccggccgtggccagtgtggtgccggagcctctagaagcggatgaaccttgggtggcctcctgggagttagtcgacgttgctatcgggacggaggtggataacttatataatgagccattcgcagtttcgccgtataattgcttatacttagacatgcatggcttaatctttgagacaacggtcggagatgcgccgaagctctctcctacgttcactttcattacgcgtaggggtttgacacccgaacactcgcatacgaagctgtcgaatcaaagacgcgcattccgctgactaaaatgattactaagtaaatacacgtccttcatttgctgaacgcgttcgcctaatttgggtgctccctacgaagcttcaaggagatagggcccagtgcttttagctacgtacacttcgacagttttatccgcatctcccagaagccccacattcttcgtcgcccagatcaggtaggaatacccgctgaacttaagcatatcaataagcggaggaaaagaaaccaacagggattgccctagtaccggcgagtgaagcggcaacagctcaaatcccgccgtttacccgcgcttggtcgaatggcttcgctttgacattcagagcactgggcagaaatcacattgcgtcaacaccccgccgtttacccgcgcttggtcgaatggcttcgctttgacattcagagcactgggcagaaatcacattgcgtcaacagcagggaggttttcctgggccaaccagagcgaagggcttaagttcgggggtagaggcggaacaacctttcgtctcttcgttcgttcctctcttcgttcctcaaaagtttgaggcaataacaggtctgtgatgcccttagatgttctgggccgcacgcgcgctacactgacggagccagcgaggactcccttggccgaaaggcctgggtaatcttgttaaactccgtcgtgctggggatagagcattgcaattattgctcttctattttattattccatgctaatgtattcgagcaaaggcctgcctggagcactctaattttttcaaagtaaaagtcctgttacgggtaacggagggttagggctcgaccccggagaaggagcctgagaaacggctactacatccaaggaaggcagcaggcgcgcaaagactggaaaaactaagacgaggacgatcaagatagaaaagaccaggctgatggtaggtaggctagtcacaaagtaaaggaattgacgtttttgcaaaagggggcaatggttaatttatagtaggaggagcttggtgatgcttctcggggttcttcctttaggtgctgggctcttccggccattaaaccctagctccggacaaaccgatttcagggtgatagaccgttaagaagaaaagcgaactcttaccgatatgtaggttggatatgagtcgtgtggtcatcccaggtagatagagatgcctaaccccggtacgggtaacacatacctacgaatctctgctcctaaaaatatgggttctgtggatggatggccgctggctaaacttaccactgagcaacgggagatcgccacgtgcagcggacaccgccgtggttgaagctgtgcgctgagcacattgactcgccaaatttcgcggtggccgcagaagggcaaaggcagagggtggggaagggagcatgacgttgttagattctatcagactaagcgtcgattaggaaggaatggcacgcgtcggggagaagtaaacagactggctttgacgcggtttaatattgtgcaccgctttctggcatggattctgacttagaggcgttcagccattatccagcagatggtagcttcgcggcactgcccgggcggacagccgcaaaaaccaattatctgaatgagcggttcctctcgtactaagctcaattaccattgcggcgaggtcatcgaccagaaaatggaaaggtactacatagcacacccagacactctcaccatgatcatgcaagcacccggccagttacaggccacctacctatcagttttttcgccagtcaagagagcctatcgcgaggagcttgcgaagaaggatattctaattgattcatcgccaattagcaagatgaccttccttcagtgttatgcaaaggctcgattaatcggtctaacagatacgaatattcgctcgggctggatcgtcgaatcttgtggttccttcctgtctatccgaggtgatgtaatttctctcgttcaccaaagtgccaaagatttccttccgaaccgatattgcggttgcaatcagcggtggatcgatgtacgagctctcacacgaagactttccctgtgcatgcaccgggccagttttgattttccgcaaaattcatttgtatgggaaatcaaaaaaatcgactcacggccaccaaaccgcgcgaccgccgggccagttttgattttccgcaaaattcatttgtatgggaaatcaaaaaaatcgactcacggccaccaaaccgcgcgcccgatatatattgaagagaggcttgttgtatgactgttgaccactcggaaacccggtcaaaagagccttcgtaggagcccctcgggtcatacggccgaaacgcacgataaagctgttcgtccgaccgggcagtgccgcgaagctaccatctgctggataatggctgaacgcctctaagtcagaatccatgccagaaatcggtgataccatttaaatattctatttaactattactttatagatagtaagctattaaaaacttatattttatatctatttatactataagtaattagattaaaagctccgggtcaggggcctatattatcgaacctggccagaccaccgatcacaaccatcccttcgctccaaaggtcgctttcccgaagttccgaaaagagaggttgtttgccggacctcgcttaccgggcatagctgcgtaattgcatagcggctaaaaccgagtaggatttaatcaatcgatcaatcaatctaatctccttgtaagccggtcggcagcaagtttcgcatgaattgttttctaatctcgagacgacgagctactatgcagtccctgtatctagccactgtcctcgacttacagcgcttcccaccctctaaaacaataatttaccgcggctcttaacaacttttttgcggcgatttgagcatcaagacagccaccaccgaggacatggaggcattaagacagtttgctgaagactgggaacaccggcttggcaccaacgctgcggtcagaatcccaacttacggtatccctggcgcccggtctgtctctcgggaagcggctgcagggtagccagtctatctttacatcccgcacatctccttctccaggatcttaggcgatatagccttcagggtagcttagaagagatgggatggcgggtttacaaaagtcatgtatatcggtcgcggcgcacccaacccactacataatcaaccacagcgcacccacaccaccacaaatccaaccacagcgaatgcacgccactgaaaattccccatcaaggattagcattcggaatacccccttcgtacgaggagctgtataggaattaaagtgcttaatccaatccagaccatcgcgaagagagtcagagcgaccatcttgggctgggaagtgtttgttcaaatggttgcagtgagttttttttttttttttctttgtgaatgatagtgcggtgttgaagaggaggaaaaacgcgtagcaggaaaaagggcgggttcaaggtgaacagcctctggttgatagaacaatgtagataagggaagtcggcaaaatagatccgtaacttcgggataaggacaaggtgaacagcctctggttgatagaacaatgtagataagggaagtcggcaaaatagatccgtaacttcgggataaggcttggctctaagggttgggtacgttgggctttgggaggacgcctcgggagcaggcagccactagccgggcaaccggccggcaaggtgaacagcctctggttgatagaacaatgtagataagggaagtcggcaaaatagatccgtaacttcgggataagggttggctctaagggttgggtacgttgggctttgggaggacgcctcgggagcaggcagccactagccgggcaaccggccggacgatagctttacggcacgcccagaagaaactcatcgaggcctcttcgtattctcgctgtacttctgggcgcgcatcaccaggacaatccaggtatgctccaatagcaaggacaatgaagagcaacgcgagccatcggatatctacagacgatagctttacggcacgcccagaagaaactcatcgaggcctcttcgtattctcgctgtacttctgggcgcgcatcacgaggacaatccaggtatgctccaatggcaaggacaatgaagttgacttcctttcaattattgaagaggtgcgaaggaaggctttcaaagagtcaactatcaaggcagccttcaagaagtcaggaatttatcctcttgactgctccattattataaaggatattctcaatcgtcaacctctcaacacgccgtcgccagctcacgaaccctcctcttctgagataacctggaacgggacgccatagagggtgagagccccgtacggttggatgcctagcctctgtgaaactccttcgacgagtcgagtggagcataaccagcttcctctttttaaacatactctgaatgtcaactgatactccacacagtgctatttgccacaaaaatgcactttatacaaaatctacatgaattaagacttagagccaaagcagttctttgttccatttcttggacttggccaagctcaacagggtcttctttccccgctgattctgccaagcccgttcccttggctgtggtttcgctagatagtagatatggacagtgggaatctagattataataagctaaatagaatatatttattttaaatactatagctaattattctaataagtttatttatatttctatttctaatagtacttagaactatattagtactattactattagtaattatattaactttattctaattctaatttaagctttatataataattagattattattactattttaaaaagtaaaagtaagaaaacttattaattaataattaaacttaatacttaattagatactcttaattagaatattattatttagaatattcttctatatactcttctagtttaaatagttatatctatattagctttagtttgaaatattcttaagactcttatagagatactctctctatataaagagtttaataagagtaagattaaaagagatagtactaagaaatatattctaaattagaactagaatactaatatatttaaagagctttagattaatttttattctagatttattttaaattataattagttttataatttaaagttttagttttatatttttaatattaatattttactttttttattattttatttctattatatttatttaattataattaatagtttttattttattttaatttaatagaatttaaatattatttaatagaatttaaatattatttaatagaatttaaatattatttaatagaatttaactgagtggtcacttggacaggctagacggcttcggcttcgctggcgggtgattcatagtgggcgtcgaccctcacgaaagcgggaggcctaccgtgtagcgagaaataaaaaagggcgtgtcataaagaaagccctcagaaaaggccatcaggagaaggttgagaaagcatctgagtccccaaagtcgctttggaaactcgccaagtgggcgaggaacaaggaggccccagcacctacaaccacgccagccataaaggatccctcctcttggggcgcccaagccgcaccggccctagtggtcttggtgtggtggaaggatgccctggggaactgagagggggtagtgtagaggctggatctgccgctatccatagtttaaacctcttaaatagttacctcggagttatctgatattaccggaaatgaaaaggcagggtttatttgcaaagacagggtgtatttcgggggtcaccaggagcgcaaggcccgcagggttggtatgagagttggtcaaagccacaagtaattttgatactgaagcctccatttgcagccagcggctcactgtagggttttggctagggtcaactgagccgactaatgcggtaagcgatcgtaagcattccgtgagtcgatttttttgatttcccatacaaatgaattttgcggaaaatcaaaagtggcccgggaaccgaccgtggcgggcacgagggtaaatgtgggtcggtgcacctatgagagaggggcgcgagtgctgaaggcgaaagcctaaggcgctgcagctatacatagttgcggaagcggcactaactgagcccgcaagagcacgcggggtctggttatgctccagctggcagctgaggcatatatagtctcgaggaggggctgagttggcgtgcgtgcggttgtctgagggcccttagggttttcgctgttgttggtttctaggaccgccgtaatgattaatagggacagtcgggggcatcagtattcaattgtcagaggtgaaattctttctaactagtaattacagaggggatccggggccccttatatccctgggaatcccgtgatcgtattctcatgcgagcagctcggttacgggctcgtaaggtcattccgatatccctctggctagtaagcgctggggttggaattttagcggggtgatacacgctatggctgacttccagttgcttatgtatactgttgtgggttgtgttagtagggtaggtgccctgtaactggccgggtgcttgcatgatcatggtgagagtgtctgggtgtgctatgtagtacccctgcgttatggtttaacagatgtgccgccccagccaaactccccacctgacaatgtcttcaacccgggtcggcccgcgcaggaccttaaaaccagaagttggacgtaaatccagccccgcttcattgaataagtaaagtgtaggtcatgtgaggtgcaggttatgtaaagtgtaggttatgttgagtataggttatgtaaagtgtaggttatgtggagtataggttatgtaaagtataggttaggtggcgtgtgttgtgtgtgaatatgctttggtggcattcccagtgaggtgaggttatgttgagtataggttatgtaaagtgtaggttatgttgagtataggttatgtaaagtataggttaggtggcgtgggttgtgtgtgaatatgctttggtggcattcccagtgaggtgcatgtgctgaagtttggttcccggcgatgtgcatgtgcatccaagaatttcacctctgacaattgaatactgatgcccccgactgtccctattaatcattacggcggtcctagaaacaaacaaaatagaaccacacgtcctattttattattccatgctaatgtattcgagcaaaggcctgcctggagcactctaatggagaagggttaaccgcagcgggtttgggttgggttctgagttcggggggcaagtgcaggtatcagaacatttgctgtgcgatggtatacttataaagataaattaactaataatcttatataactaacttttcttatttctaaataagtataattttagattaaactaaaataaactggtagtagcgacgggcggtgtgtacaaagggcagggacgtaatcaacgcaagctgatgacttgcgcttactagggattcgtcgttgaagagcaataattgatagatatcagattaatattaaatctatattattcctaataaaaaccttctatagtagtaaatatatactatacttataaagataaatatgtttctggcgacgtgccttccgagttccctggaacgggacgccatagagggtgagagccccgtacggttggatgcctcgcctctgtgaaactccttcgacgagtcgagtagtttgggaatgctgctctaaatgggaggtatacgtcttctaaagctaaggtaacgtgagctgggtttagaccgtcgtgagacaggttagttttaccctactgatgacctcgccgcaatggtaattgagcttacttatagagataaattaactaataaccttatataactaacttttcttatttctaaataagtataattttagattaaattaaaataaactctaatatattaatactccttaccagcacgcttagcctataggcatatcttagtaggatatattaaatagggtaatcatgaatgcttacacgctggaagaggtcacgcttctcaatatattcatcgcggcgggatcaagcagcagcgatggttgaaccgggcacaaagaataggcgcgcaggcgatcacgggcgccttccgtacgactgcgttggcggtagcggaagccgaggccaacatccccaccatcgaggagcggcacgcgcaggccggcacacgactctacatcaacctacacagcagaactggcgatgcgggatgaaccgaacgcgaggttaaggtgccagagtagacgctcatcagacaccacaaaaggtggtagtacatccagacagttggacggtggccatggaagtcggaatccgctaaggactgtgtaacaactcaccaaccgaatgcgaacatggccaacgttgatatttttgatggttttggtaatgccgggatggctcaacctccacagctccagctcgccatggatagcgattatgatcgtaagttccccgttgaggaatatgacaagaagtacgcgatggacttatatattgggagtatggatggggttgatttgtccgacagcggggaaaatctggcggtgacgcttgggcgagttgtgcgtgaatggaagatagaggatcgagtcggaacagtgatttcagacaacgcatcttcgaacgacaactgccttgtgaacttctacggagaccttgacgcagaaatgggctcggcggataggatctgccgctatccatagtttaaacctcttaaatagttacctcggagttatctgatattaccggcaatgcaaaggcagggtttatttgcaaagacagggtgtatttcgggggtcaccaggagtgcaaggcccgcagggttggtattttctcgtcttcccatccaaacgctggcactccatgactcccacaaggctcgattgattctaatactaaaactagtttaagttctctatatagtttatattatatagatttaatttatatatatatattatattctgaaactgagccaccgataagcgttaggcacgttaagaccttcccctccaatattattaatgcatgatccgatatacttgagtgctagcattcatccgatgcagattttgtcccgtcatggtcggcttgattgccgacatcattttggacacaagcgattcctctctaccttttagtagcgtgaaaattcacccaccaaatttcaacggatcctactaggaaccgtcgtggcattaatgataggcctagttgagatccctctttatctagcttagaataataaagcggtgaaagtatggattttcttccttttttcctcgttcacaatacaacgaaaataacgcacctcctccagcgttatggctactcaactccttgtttctcaccgtatcacgattagcgagcctcttcttcatcctcatccaatgaactcgatccctatatcacctggctgagctaaggttggttttccatatctatccgagcttgtaacaaccatggtggttgagattatgcccatcataaagccagtctcatcaaagttgtggaagtcctcctccagtataccatatttcgcgactgtattgcgcaccttcccgcggattttcaagggacgtcgagagcgcaccagacccagcagaggtgctgggctcttccggccattaaacccgagctccggtacattgtggctgggatagagggatgtctagtcgatccgcgcattgctacatgtactcgagccgccggaggaaaaggggcgtgcgctcttgaccgtctggctttcagctgtcttcgccacagacctcctcgcgctactctctgaaaggaccagaggctgaggcttttaacttgagaatggaaccgtgctctgcaaaggagcactaacgaagcgttccgttacctgccgaagtatagaaaagaagacaacgttcaagaggtctaaagcgttacctaggtccaaaatatctaccacaatcaggaataaatcagtttgactcccccaatgccacaggttcttaccagctgtatcatctaccttagcccggataaaaggctcaaaaatgccacagttgcggcagcatgtgcctgttgttccgtgacctctctctcgcagagcacggcagaggtcagcagaggtaaataggttatcaatgaagtgagcgccatccattttcagggctagtacattcggttggtgagttgttacacagtccttagcggattccgacttccatgtccaccgtccaactgtctggatgtactaacaccttttgtggtgtctgatgagcggcgtgatttggtacagcatgcggtctttattgggcgtggtttgtcactttttggaattttcgaccagaaaatggaaagggactacatagcacacccagacactctcaccatgatcatgcaagcacccggccagttacagggcacctaccctactaaaaccctgtggggtgcaggttatgtgaggtgcaggttatgtaaagtgtaggtcatgtgaggtgcaggttatgtaaagtgtagggtatgttgagtataggttatgtaaagtgtaggttatgttgagtataggttatgtaaagtataggttaggtggcgtgtgttactactggcagaatcaaccaggtaactatcgttcgccggggttggccaccagcgcccacgaggggcactggagaattaggtactgaatggcactcgtgagagcgcgccgaacacagcaccagcggcagggccaccgacgccgcgcacggcaatccacctgtttatggttaagactacgacggtatctgatcgtcttcgatcccctaactttcgttcctgattaatgaaaacatccttgtcaaatgctttcgcagtagttagtcttcaataaatccaagaatttcacctctgacaattgaatactgatgcccccgactggcgcggcaacgcaactgaacgcggagacgacggcgggggccccaggcagagttctcttttcttcttaacggtctatcacgctgaaatcggtttgtccggagctagggtttaatggccggaagagcccagcacctctgctgggtctggtgcgctctcgacttagtcttcaataaatccaagaatttcacctctgacaattgaatactgatgcccccgactgtccctattaatcattacgccggtcctagaaaccaacaaaatagaaaagatacggtacagttgaagagatttcccacagcggatcggaccagcttgttacagttgacccgagacgctgtgagtggtttgggagaaggagatgtgcgggatgtaaagatagactggctaccctgcagccgcttcccgagagacagaccgggcgccagaactcaagctgtgcaatatctcaattgttctggactgaaggccatcggcgtggcccttttcaattttcgtggtacgtttatccataacctttgtcttgatgctataaaccgccgcccatgctgcggccatcaggctacgaggacggtcagcctcaatgcttcgtccactgactgatccaggttgagagaagggatcacaatatgagaaaaccactagagataaaccactagagattattcaagctgactgtgatatattagtatcatatgccttgacatcctgtaagagcaagtcgtcctagccttcaccgcacagggcgatgagctgcaacaggtctcagcctctgtaaaggagtggaagaaagctgtacgaaaggaagagagaaactcaagcttgctaatgtgggtaatatgcatccgtattagcttctcaacctctcttccgtacgactgctttagtggtccaaagcagccaacatctaatggctgaagaagatgaggtcgaaaatgacacttaaaatcttggaggaggtctcagtatgctcattgtcagccattagtgcggactgactgggaatcctgaaggagtttgtcactttttcagaagctgataagccctttatccgcactgacaagcgcacagtaaagcgcgccgcagggagcaaccacgatagctttacggcacgcccagaagaaactcatcgaggcctcttcgtattctcgctgtacttctggacgcgcatcaccaggacaatccaggtatgctccaatagcaaggacaatgaagagcaacgcgagccatcggatatctacagagggagcaaccacgatagctttacggcacgcccagaagaaactcatcgaggcctcttcgtattctcgctgtacttctgggcgcgcatcaatatagccagatatataaataacccagctatagctatagcccctaagaggggaagcttattatctaatagtaataactatctttcctttttatcgtctccacacttagatcgtatcgataagctgtgtatttaactactggctggggggatgcagacaactgcctggttgagcaatatgctcagactgtatgcttgcctcgtacgcagtctgtggtgtctttagaacccagggctgccttatctcaggcaggatctctggtggtgttggtgttcgtagcaccacatctagctttgaaagaaccctctttgggtcgtacggtattaggccagatccaataaagcctgcctggatattttcgcaacgcaactgaacgcggagacgacggcgggggccccaggcagagttctcttttcttcttaacggtctatcaccctgacatcggtttgtccggagctagggtttaatggccggaagagcccagcacctctgctgggtctggtgcgctctcgacgtccctgaagaaaaaggcgacaataaattcgatgcatggctgattgaaaatatcaaagtctagctcgagaaggtccttgcttcgcttccaaaaaatgtctccgatagtccctctaagaagccagcgtactgccaaagcaatacgggctagttagcaggttaaggtctcgttcgttatcggaagccgatagtccctctaagaagccagcgtactgccaaagcaatacgggctagttagcaggttaaggtctcgttcgttatctctatttaaattagaattaatagaaattaaaattttattagatattagaaaaatatatttattttttaatatctaaaagtattattataaaaaagcctggagcaaccattgcccggaccggaaggaagagatgaatagaatcaaagcggcatatctcacaaggccaaggctttatccggagccaacaggcacagccactcgatggccaccccaaccacaggccgagagaatcaatattgccaccggaaatcgctgtaagcagtagagtagccttgttgttacgatctgctgagggtaagccgtccttcgcctcgatttccccaatacaggcggcccatcagcttgcgttgattacgtccctgccctttgtacacaccgcccgtcgctactaccgattgaatggctcagtgaggcggccggactggcccagagaggagggaaaccaccactcagggccggaaagctctccaaactcggtcatttagaggaagtaaactcttggggcgcccaagccgcaccggccctagtggtcttggtgtggtggaaggatgccctggggaactgagagggggaaggcacttccctccgatccgcgtggaaggcgggagaccggtttgaagttggggtaccgggtaggcagaaaccacaaccagctcccctatacccggcgaactcaaaccaaatctgccgccgccacgcagcctcgggcagggtgagaggataatgagaggatgcgcggcaacagctcaaatttgaaatctggcgcaagcccgagttgtaatttgtagaggatgtttctggcgacgtgccttccgtcagaacgccaaacggacgaagacagcatcatgaggctgcgaaaagagcattcgaaacagcgctggacttatttgagggtatgtcccaaggcggtcgaccttgccccgtactagtcaacaactaccagcacctagaaattggtccggttgtccatttaccaggcctcgccaacatcgcagagcgcgaacctcagtccaccccagggtattacacagtgggctataacactcccgagggagccacattcccaaagcctgtatcccccggggcgaactgatgctggcctgggcaggcagagtgcaccgcggagaaccacggatgatcaacctgcccaagtattccttcccgcggattttccagggacgtcgagagcgcaccagacccagcagaggtgctgggctcttccggccattaaaccctagctccggacaaaccgatcgccgcaatggtaattgagcttagtacgagaggaaccgctcattcagataattggtttttgcggctgtccgaccgggcagtgctgagatcctcttaaaaagctcacacctctgaggggacgacctgatgaacttgacaacattgtggagttttcccaccggccctttctttctccaatgacgtaggtcatcctcgtatcggccgagaaggtcaaagaccatgcatcctctcattatcctctcaccctgcccgaggctgcgtggcggcggcagatttggtttgagttcgccgggtatagtgtagctggttaaataaacgataacttatataatgagccattcgcagtttcgccgtataattgcttatacttagacatgcatggcttaatctgcggaatatcactacttcgcagaggaggccacgacgggtccgccactagatttaggggccggccgtccctcgcgggctttccatgccagaaagcggtgataccacccgcacgtacagatggacaagaataggcttcggcttagcgtcttagcaggcgagtactctacggtactagaagtgtgctgtagtatttcgcgtattgtaattttaaaacgagcggggtcaaatcctttgcagatatttcaatgagaacttgaaggaccgaagtggggaaaggttccatgtgaacagcggttggacgtgggttagtcgatcctaaggggaacaagatcgctgtccgatgcactgtcagcatgatcattggggacagcccggagcagaacatggaattgatgttcaaggcagagagagatgatgagggtcgatttgaaaatgtctgggaactctcaaagccaatcgacaaaacggcagattgatgaacgagcttggactaccctgaaggctatatcgcctaagatactggagaaggagatgtgcgggatgtaaagatagactggctaccctgcagcctcggccgtccctcgcgggctttggccgatccccaacaccacgccctaggggcatgagggttgaaatgacgctcagacaggcatgcccaagtagtgcggagacgagagcgtttaaacccctgctgtaccccccagctgaactctaaagctcaggccatcaatagatgcggatgactacaggccattagcggcccctcaaaagtgtaaaaaaacgagctgtttctctccatgaactcgtgatctaccaggtatacgtcttctaaagctaaataccggccagagaccgatagcgcacaagtagagtgatcgaaagatgaaaagcacttggaaaagagggttaaaaagtacgtgaaattgttgaaagggaagcgttcatgaccagacttgggcaggttgatcatccgtgcggccgaagcctgctaagggcatcagcacccaggtgctggctgccgccggccggttgcccggctagtggctgcctgctcccgatttggctaccttaagagagtcatagttactcccgccgtttacccgcgcttggtcgaatggcttcgctttgacattcagcgcactgggcagaaatcacattgcgtcaacaccacttccgtacggttggatgcctagcctctgtgaaactccttcgacgagtcgagtagtttgggaatgctgctctaaatgggagggatacgtcttctaaagctaaataccggccagagaccgatagcgcacaagtagagtgatcgaaagatgaaaagcactttgaccgttgttgaaagtttttatttatttgtaaaaactactcagaagattccaaaataaaacaagaattaagtttcctaggcgccgttgttgaaagtttttatttatttgtaaaaactactcagaagattccaaaataaaacaagaattaagtttcctaggctggcgcctgatccggggcacacgaggcgcccggggcaagccctccctgtatctagccactgtcctcgacttacagcgcttcccaccctctaaaacaataatttaccgcggctcttaacagttggaaggttgcaaagcgcgtaccgcgtcttacgcgggtgtggaggaattgaccggaacttttgattccccactgtatccgccccgacaaactccttgagtgcggcgatttgaggagccccaaatacgacagcggtgtcatagtagtatgatctcccaggcctttcggccaagggagtactcgctggctccgtcagtgtagcgcgcgtgcggcccagaacatctaagggcatcacagcccaggcctttcggccaagggagtactcgctggctccgtcagtgtagcgcgcgtgcggcccagaacatctaagggcatcgcagacctgttattgcctcatccagtgcccctcgtgggcgctggtggccaaccccggcgaacgatagttacctggttgattctgccagtagtcatatgcttccagtgcccctcgtgggcgctggtggccaaccccggcgaacgatagttacctggttgattctgccagtagtcatatgcgtgtctcaaagattaatcgctccagttatgaaagatagctctgaaaagaaaaacatccgcgcctgtggctttctgtgttttaaacatatcgtgtgtttcaaatataattcggtcctggacgtctgtcggcactttcagtcgtccttcagcaactacatcttcaaaatcctgaacaatttataaagtatagatattttattctatataaagaaataagctctatagaaaactttatatattaatttctataatattttctattagttttactataaataaagatatattctaagatcaggtaatatataatctaatatatattttttaagccatagctatccgggcggcaaaaccgacagtgagccagctttctgttatacgctgggagaagaggcaataccgagttactaatatgccagcccggacgaagtcagtgctttcgccatagaaggagggagcaaccacgatagctttacggcacgcccagaagaaactcatcgaggcctctccacagagggaaaggcccggccggaccagtacacgcggtgaggcggaccggccagccaggcccaaggttcaactacgagctgaagtctgaagaactatgtttagccaatcatcaggcctagtcaaacgtaatgagatgccactcccaattgcgctgaagaggagttttggattaaaggcccaactgtcccgccctcgtgagatacccagcctcgtataatgctgtatagactccctgagagttcgataggcgtccggacttgctgcttcgcttgatttgcgactgatatatatagcttttataaaacccacttttatctgaaagaggctcttaagctgatcagttgagtatagatattaaatatcttatctttaaagctgaaggaactattcaagatctaagacctagtctagggtaggctggttcccgaggcttgttctcacatttccgtccagtaactctgttctccatctggccctattcgtgccttgggaacgctttttttctgacatacacggcgatgttaccgatttatggctcggatacgaagcttctctctgtcaccggctacgttttcacgtctccaacatcttatactatacttatagagataaattaactaataattttatataactaacttttcttatttctaaataagtataattttagattattaacaagattacccaggcctttcggccaagggagtactcgctggctccgtcagtgtagcgcgcgtgcggcccagaacatctagttctgtggatggatggccgctggctaaacttaccactgagcaacgggagatcgccacgtgcagcggacaccgccatgggtgaagctgtgcgctgagcactcctcttggggcgcccaagccgcaccggccctagtggtcttggtgtggtggaaggatgctattaataagtaatataataagttatataacaataactgttatataatatatacataatagaataaactactttttataaacatatactaaaaaataaataaagctgtgcgaaacggtcctgtaagcagtagagtagccttgttgttacgatctgctgagggtaagccgtccttcgcctcgaagctgtgcgaaacggtcctgtaagcagtagagtagccttgttgttacgatctgctgagggtaagccgtccttcgcctcgctttccccaatacaggcggccctggtggctggctgcgtagggggtttgggagatggattacaaggacgccagagttctggaaagcccaacgtacccaacccttagagccaatccttatcccgaagttacggatctattttgccgacttcccttatctacaaaagcccaacgtacccaacccttagagccaatccttatcccgaagttacggatctattttgccgacttcccttatctaccttgttctatcaaccagaggctgttcaccttggagacctgctgcggttatgagtacgacctggcgtgagaattattcctttgaacggcactcgtgagagcgcgccgaacacagcaccagcggcagggccaccgacgccgcgcacggcaatccaccttccccctcgaggagagtcacagttctctgcctcaagaggcagtgtacacagagagctgcatgaagtcggttgtgattatacgccaagcaatgtctcctcttcaggttcagacatgggtattgacgctcttaatattaaatttcttttcttagattttaattataagataattagtttttaaattaataattctattattatatttaaattttaagctttctatattagtttatatttattagtatatagaagagaagttcttttaagatatttaattatattatactcttagataaatattattagaacttctttatttatttcttaactttatttattagtactaatatagttagttctttatatattatattttatttctttttattaatagagattatttctaattcctctgaattattactatctctattactagttagagaaagtacttcttctttatatatatattataattcttcctcctagtactagtattattagagatatagtttaatagtatttatattattattactatatattactaattctaatactttctatttaatatatttataatttctatatctctagttattatattatttaatctagctattatatatatatattacttaattttctatatacttctaattatattataacttaagactcactcgccaagagatattcttgtgcttcatcgttctcgcgtgagatcctcttaaaaagctcacacctctgaggggccgacctgatgaacttgacaacattgtggagttttcccaccggctctttctttctccaatgacgtaggtcatcctcgtatcatttgtatgggaaatcaaaaaaatcgactcacggccaccaaaccgcgcgaccgatatacatgacttttgtaaacccgccattacaagcagctgcaactgtatgcgttgtcatgacgcgtttgtcttgaacagaccacttcttcgttccatccgggtcatactgttcaacgtaggtgaaagctgcctcggctagccactgtttgaacggcttattgactgctgtatcgagaggttgaagatatacgaccttaataaagaaaccacaaccactacattcctcaccggttcaacacattcctcgccgccaaacctgcgtgtgctaggcgcagcggttgagtttcaaggtcacgaggctgcgtggcggcggcagatttggtttgagttcgccgggtatagggtagctggttgtggtttctgcctacccggtcccccaacttcaaaccggtctcccgccttccacgcggatcggagggaagtgagaaggccagtatttcaaagagctcgcgaagaccgctatacttccgcccacgtccgggaggtcgcctacatcatcgaaacatagcttgatctacacaaaaagaagcttgtcaaagcttgggttgatgagcaccttcactttgaaaatgtggttacgtctcgacgtactcataaccgcagcaggtctccaaggtgaacagcctctggttgatagaacaatgtagataagggaagtcggcaaaagacgctttgccaaatgacaatttgcgagacgacgtattggctttcccaccatgcacctttcggcgtataccctatttgcagttactttctcggtgtcgccaccaacagaatagaaaaatgcttttgtctctccccttttaacataatatttatcgctcatctacaccgcccgggcctttccctctgtggaaccctatgcccttcactgggtgtagcggggaaacaggacttttactttgaaaaaattagagcctgcaccccacaggctatctcaccgcctgtagctcacgctcagtagaccggccctccctgtatctagccactgtcctccacttacagcgcttcccaccctctaaaacaataatttaccgcggctcttaacaacttttttgattttacataccctgcagggacaggcgagatggcagacctagaagaggccatcaaaataacaaggcaagctgtcgaattgacaccagatgaccatgccgaccaggcaggctggttgaacaaccttgggaacaagcttgactgcaacgggacgccatagagggtgagagccccgtacggttggatgcctagcctctgtgaaactccttcgacgagtcgagtagacgccttggtcttgatgatgactaccgtttacaccggccaagagcttgtcgtaaagcttcgcaagagaccgacaactacaaaagcaagggcacgcccgatcaagagggaatttagcggaaagccagtcaaattccttcagatcccgtcagtttcagcggattacaatgacaacatgggtggtgttgatatcggtgatcaacttcgggcttcagagggattgcaacaccgggtttataagggaatgctcacgttcaattaagcaacaagagcttcttacatatttaaagtttgagaatggatgaaggcaatatatagcccccgggtagctggttgtggtttctgcctacccggtaccccaacttcaaaccggtctcccgccttccacgcggatcggagggaagtgaccacctaacctatactttacataacctatactcaacataacctacactttacataacctatactcaacataacctacactttcttggtcgaatggcttcgctttgacattcagagcactgggcagaaatcacattgcgtcaacaccactttctggccatcgcagaaacgctttgcaggcggtgctctcggactatgtctgcaacggggacctgacatgggctcaggctactcagatagtcaaggatattctcttcaataacgcgaacacagtgtacaatttgaggttgatacatcgccacatacgaccatacccattcgagaacacgcgatcccgtccgctctcgcctagttaaacggatgaggggcggattagtctgtacgtgcgggtggtatcaccgctttctggcatggattctgacttagaggcgttcagccattatccagcagatggtatcttcgggaggtagtcttaaagatggaggcagctcctgttcccagccgagtagattggcttcgaagttgaccaggtcttggaagttacccgcttcaatctgccggatgagggaaggggctttaaacatcatgttgggctcctcgccaccatatctgtaatgtggtaagttggaggcccaattaactccaacagggggcgcgtcgcgtacgcgtaggaggatattggccatttcctcaacactacgtatcctaggaggaaacgcacgtgtagatagctcaatctaatagggaacgtgagctgggtttagaccgtcgtgagacaggttagttttaccctactgatgacctcgccgcaatggtaatgataggccacactttcatggtttgtattcacactgaaaatcaaaatcaaggggacttttacccttttgttctactggagctttctgttctccatgagccccccttaggacacctgcgttatggtttaacagatgtgccgccccagccaaactccccaccctctagcttcacacgtcgaaggactaaaggatcgataggccacactttcatggtttgtattcacactgaaaatcaaaataaaggggacttttacccttttgttctactggagatttctgagtcctgtttccccgctacacccagtgaagggcatagggttccacagagggaaaggcccggccggaccagtacacgcggtgaggcggacagtcctgtttccccgctacacccagtgaagggcatagggttccacagagggaaaggcccggccggaccagtacacgcggggaggcggaccggccagccaggcccaaggttcaactacgagctttttaaccacaacaactttaatatacgctattggagcgggctctcaccctctatggcgtcccgttccagggaactcggaaggcacgtcgccagaaacatcctctacaaattacaactttttgcgcggcaacgcaactgaacgcggagacgacggcgggggccccaggcagagttctcttttcttcttaacggtctatgtctgcgactggaattcgggactagacatggtccaattgaaacctagggcaaatcttcgctaagtcccacttagaatccgaaaggtattccaaagtctctttctcggctagcactttagactattaatacgcattgtgattaattgtgctcatctcgttactatatataaataggtattagattaatattaaatctatattattcctaataaaaaccttctatagtagtaaatatatattatacttatagaggtaaattaactaataaccttatatcttccgaagtcgggattttaagcatgtattagctctagaattaccacggttatccaagtagtaaggtactatcaaataaacgatatatatagcctttttaagacccacttttatctgaaagaggctcttaagctgatcagttgagtatagatattagataccttatctttaaatggtaattgagcttagtacgagaggaaccgctcattcagataattggtttttgcggctgtccgaccgggcagtgccgcgaagctaccatctgctggtgttcacccactaatagggaacgtgagctgggtttagaccgtcgtgagacaggttagttttaccctactgatgacctcgccgccaaggtgccgatacagacccgtcaactgaggaatctgaccggcccaagcgacggcgcttgcagtacagcaccgtgccgccagggctgccgtcagatcagattatcaatcagatttatcaatcaattcaatcaattcaaatcagatatgatatcctagcgaatactattatattctactctagttattagttctttagattttaatagtttaataatataattaaagaatactaattactatagttattctaatactaaaactagtttaagttctctatatagtttatattatataaatttaatttatatatatatattatatcagaaccaagagatccgttgttgaaagtttttatttatttgtaaaaactactcagaagattccaaaataaaacaagaatgaagtttcctaggcgggcgcctgatccggggcacacgaggcgcccggggcaatcccgccgaagcaacagtaggtatgttcctaaaaacaatacatttgtccaccgcgacttgaagataccacatacctagcgtatatcgctatctatataaaagggaacaatatatccattattattaatttttatttagagtatttcataatacggttctacaaagtagcgctagcagctacaggggttccgactcgatcctctatcttccattcacgcacaactcgcccaagcgtcaccgccagattttccccgctgtgacacccgagctggcgtcgaagtctatataatataagttactattaatatataagtattataaagctagtaataatagatatatagataattatattaataaatatccgctacggcttagcgggccctaggaaccctcaggggtccgggtcaccagcagagctattattaggttatcgggcttattaagcccagataagggtctaataaatccgggaaaaatcctaggatattctcagacgacctaacctatacccaggctaccccaaagtgcgcctttgaaacggaacttccctatggcttaggatcgactaacccacgtccaaccgctgttcacatggaacctttgagtggttggctgcagcgccttaggctttcgccttcagcactcgcgcccctctctcataggtgcaccgacccacatttaccctcgtgcccctatggcttaggatcgactaacccacgtccaaccgctgttcacatggaacctttccccacttcggtccttcaagttctcccctatggcttaggatcgactaacccacgtccaaccgctgttcacatggaacctttccccacttcggtccttcaagttcccattgaaccctatggcttaggatcgactaacccacgtccaaccgctgttcacatggaacctttccccacttcggtccttcaagttcgcatggatggccgctggctaaacttaccactgagcaacgggagatcgccacgtgcagcggacaccgccatggttgaagctgggcgctgagcactcctcttggggcgcccaagccgcaccggccctagtggtcttggtgtggtggaaggatgccctggggaacgggactttgcttgaacaagggtatcctttttcgtggctactgttccgacaagtcgtgggaaagcgacgcctgcgtcaaggtctgcatggacgaggcggtacgtatcgaatattcacacttttatatccgaggcatcaactcacaattgacacaaagtcatagagcaacgccggctcaagccctgcgcgagatcattgtgaacatcagaaaccctctcactgtagctaacattagagccatgaaccctcgaaacctcaaagcccacgtagaccgggcgatcgaacaaagcggcaatgagcacattaagcatatcagagtagcctcgactaaccagctcaagagcggcgatttgagcatcagaggcagggagaggagtacaataaatggatccaacgatgcctatccggtattgatagcgtacttgtcgacgattgtttgggcgatgcagaaaagtttgagccctacaaccacttggatatatttaccagaagtccgagcaaacgtattatctgcatcgaggaggatcgccacgtgcagcggacaccgccatggttgaagctgtgcgctgagcactcctcttggggcgcccaagccgcaccggcactagtggtcttggtgtggtggaaggatgccctggggaactgagagggggaaggtggattgccgtgcgcggcgtcggtgggaaaccaacaaaatagaaccacacgtcctattttattattccatgctaatgtattcgagcaaaggcctgcctggagcactcatatctggtgttttatcggcaggaggtgtgtctcgacgtctagtgccgggcccgaggttgctctgaacgcccctgataatacccttgctgccctggcctgtaggctctccagctttgctagagtatgtttggtatagggagctccgcatgttcgccagtatggtaattgagcttagtacgagaggaaccgctcattcagataattggtttttgcggctgtccgaccgggcagtgccgcgaaagaaattgacggaagggcaccaccaggggtggagcctgcggcttaatttgactcaacacggggaaactcaccaggtccagacatggggatcggccaaagcccgcgagggacggccggcccctaaatctagtggcggacccgtcgtggcctcctctgcgaagtagctgaaactaacaacctaactaccttgattttgcttttcatttacattacttccctgtttacttgccaccccaagacctcagtatcctgctcagaagttatcaagcctcatcatagaatgcctcctccagcccaaggacaatatttcagctataccaatagggacgtaatcaacgcaagctgatgacttgcgcttactagggattcctcgttgaagagcaataattgcaatgctctatcaccagcatctttgcgatgcagacccctacgatctcgcgccattgttcaaggcacgcaaggggctgccattgacgctgttcgtgggataacgagcgaaacaacctagtcatggtccattgtaaagtgaaggaggcagccggatcttggatagccacgtcaaaccacccctcaagcaatcacatctgatccatccatttagatgaatgaaaaagactgccacgtaattggtcaggttagatgctcgttgttctcccactcttctgaaaacggcgcattgccaaatgacgcattgccaaatgacgctttgccaaatgacgctttgccaaatgacgttggtttcttttcctccgcttattgatatgcttaagttcagcgggtattcctacctgatctgaggtcaaccttggaaaggtgggggtttaacggcaggggctcgtcgctctccgatgcggaatatcactacttcgcagaggaggccacgacgggtccgcacgatttagctatagtgagcgagatagctgcttttatgtcagcaatagtactctcagattcagaccaatggtagcttagttataacaaacagggcagtaacccttttggaaaagtttgcgaccacacgacattttcgcgtttctccacagacacgctcgtgacaaccctttcctttcaaccacccatttccaggacttcatccggcggctacaggcacggcagctgctggaccgggtggttatggacgagtgccacgtggttctggacggagagggcaccaccaggggtggagcctgcggcttaatttgactcaacacggggaaactcaccaggtccagacacaatgaggagtgacagattgagagctctttcttgattttgtgggtggtggtgcatggccgttcttagttggtggagtgatttgtctgctgcgatgttggcgaggcctggtaaatggacaaccggaccaatttctaggtgctggtagttgttgactagtacggggcaagccctcaaataagtccagcgctgtttcgaatgctcttttcgcagcctcatgatgctgtcttcgtccgtttggcgttctgataatagggacagtcgggggcatcagtattcaattgtcagaggtgaaattcttggatttattgaagactaactactgcgaaagcaccagacccagcacaggtgctgggctcttccggccattaaaccctagctccggacaaaccgatttcagggtgatagaccgttaagaagaaaagacatcacgaaagagccaatgatgttttcagtctggggaccaataggtacgcacctgggtgcgcacataagtgtcacgtgctgcgcacccggtgcgcgtgtaatgaatgaatgaagtttattacgcccgggaggatttacctcatagggcccagtgcttttagctacgtacacttcgacaaaaaacaacacacctctacaaggcatagagtcgctatacgtttgatgagggtcgtgatcccagttgattgtgggtcctcaaggctcctttgtattgattgaatggactcaactttgtgaaacaaaacagcagaccgggcgccagaactctggcgtccttgtaatccatctcccaaaccccctacgcagccagccaccagggccgcctgtaacgccgaaatttttaggagcagagattcgtaggtatgtgttacccgtaccggggttaggcatctctatctacctgggatgacgccgtgtggcgaaagggaagccggtcaatattccggcgcctggatgtgggttttgcgcggcaacgcaactgaacgcggagacgacggcgggggccccaggcagagttctcttttcttttagtaggatatattaaatagggtaatcatgaatgcttacacgctggaagaggtcacgcttctcaatatattcatcgcgggctgcgaggtattcctcatgggctgctgaatcaaatatatcggatggctcacaaggacactcacgacgaagagtgcctcctctgtcatcgtggagtttaccaggccccaagatgccaataagatcatcgatgaaggcctgatctggcaaggagaagtctttcagtgcgagctatacgacaggtcgtctcgttgaagagcaataattgcaatgctctatccccagcacgacggagtttaacaagattacccaggcctttcggccaagggaggataaggtacaaccaccaatgaataggttgagttgccacgcaacgcagacaggctaattgattatataatccctccagcgactgctggcggctgatacatgggcacccggatgcccaaacatcctggcgcacccgggtgcccaaattatgtcagcaccctccacaaagcacacagctgcagtcagttcagcctacaatgcctacaaggtgggttccaagtctgttgctaggctttgaattatccaagagtattgactgaaaattctgtgtttcttctaagattgccaccgattttgtgcagaccgagtttgcggccactcatcggttgcgactacgcttggcgagggagccacattcccaaagcctttatcccccggggcgaactgatgctggcctgggcaggcagagtgcaccgcggagaaccacggcaagagggtaaatgtgggccggtgtatttctgaagagtacccaggctcatgggagggcgtcccgcgggcgctgcaggggatgtaaaatcaaaaaagttgttaagagccgcggtaaattattgttttagagggtgggaagcgctgtaagtcgaggacagtcagtgggaatctgcaagatacggtacagttgaagagatttcccacagcggatcggaccagcttgttacagttgacccgatactacatccaaggaaggcagcaggcgcgcaaattacccaatcccgactcggggaggtagtgacaataaatactgatacatcgagaagttatcatgaatcaccagagagccccgaagggcattggtttttaatctaataaatacatcccttccgaagtcgatatagtataaataactatatataaatagatattagattaatattaaatctatattattcctaataaaaaccttctataatagtagcatagtttatggttaagactacgacggtatctgatcgtcttcgatcccctaactttcgttcctgattaatgaaaacatgcttgtctcttaaagattctatagtaataactaattaatctattataatactaaatattattaaattaactttatttaatttaatttttctatttaataaaatttctaataattctattctatttaattcttttctatttaataatactaattaaaataaatatttatttaatttaaaaagccagaggctgttcaccttggagacctgctgcggttatgagtacgacctggcgtgagaattattccttcccgcggattttcaccagaggctgttcaccttggagacctgctgcggttatgagtacgacctggcgtgagaattattccttcccgcggattttgaagaaaagaatggttaggaaaacgagttggcacagaatagacgccgcaaggaccgcaatcgaggcgataagggagctttttttggactccccaaagacgggccaaaactggcccgggaactgaccgtggcgtgcaagagggtaaatgtgggccggtgtatttctgaagagtacccaggctcatttgcgcgcctgctgccttccttggatgtagtagccgtttctcaggctccttctccggggtcgagccctaaccctccgtgacgtaaccgtaggccaagcggactttgaagaggtgactcttccttagaggctcgtgtttgggctgtggcctctcttacgtattggttcaaagcctcgagccgttcattgcgcgatgaagtcggcgttgacgatcttgacgatggtgatgacctgttgaactcaactacgagctttttaaccacaacaactttaatatacgctattggagctggaattaccgcggctgctggcaccagacttgccctcgagtcaatttttaacatcgtccgatccctagtctgcatagtttatggttaagactacgacggtatctgatcgtcttcgatcccctaactttcgttcctgattaatgaaaacatcaagaagctggggaccctgctcaaagtactacgaacgtcacgtccgacagaggcaatgtaggtccagttggccagctatgggagtcacgcggtgcgccgtcctttggtggctggctgcgtagggggtttgggagatggattacaaggacgccagagttctggcgcccggtctgtctctcgggacgcggctgcagggtagccagtctatctttacatcccgcacatctccttctccagtatcttaggcgatatagccttcagggacatagcattgcgatggccagaaagtggtgttgacgcaatgtgatttctgcccagtgctctgaatgtcaaagcgaagccacaccaactaagaacggccatgcaccaccacccacaaaatcaagaaagagctctcaatctgtcaatcctcattgtgtctggacaccaactaagaacggccatgcaccaccacccacaaaatcaagaaagagctctcaatctgtcaatcctcattgtgtctgtacctggtgagtttccccgtgttgagtcaaattaagccgcaggctccacccctggtggtgcccttccgtcaatttctttagaagccgtctagcctgtccaagtgaccactcagtgggaatctgcaagatacggtacagttgaagagatttcccacagcgcatcggtgcacctcactgggaatgccaccaaagcatattcacacacaacacacgccacctaacctatactttacataacctatacccaacataacctacactttacatattgctcttcaacgaggaatccctagtaagcgcaagtcatcagcttgcgttgattacgtccctgccctttgtacacaccgcccgtacgagagtaaaccaaggtccgataacctttggatcttcgcatttagccctctgatagtcatatttccgaacccagcgcgtatgaagctctggttgccgcttgatgaagttggaggcccaccaccgttgctgctgcgcagcacgtcgaacttggggagcgtgagcttgaagagacccgcgagttcgcccgtcgcgatgctgttgccgatgcctatgccgatgcgtacgcttcttactacaagcgtgccaccgtcctccaggcccgtgctggttgcgtaagtttactcttagctcaaaccgtattcataaattacgctaaaacatccttggaaatatagactggtgctcgtggtatctgtgtcaatgggagacacccctttcctacatcatgtgcctttgaccaggcaccccactataggactactagatgagcacatcaagccgtagggtcataggactctctgagcaaggtccaaatgtccgaaaattcacgcttaaatgctctctcctcgagacacccctttcctacatcatgtgcctttgaccaggcaccccactataggactactagatgagcacatcaagccgtacagggcgatgagactagagagatcaaactacacaatatctacaatcccgaccaaagagtggagaacagacagagcatatcttaagaatagctacctacttatacaggcctactataacctaatatataatttatagtttcagtatattatatactattattattattattatttaccctaggtgctaggtctagctagtctctagtccctctatctaatctctaacaagggaaaacgcctggtctggggagagctctgctctcgccggcgctggatgggttctgtggatggatggccgctggctaaacttaccacggagcaacgggagatcgccacgtgcagcggacaccgccatggttgaagctgtgcgctgagcactcctcttggggcgcccagactgtccctattaatcattacggcggtcctagaaaccaacaaaatagaaccacacgtcctattttattattccatgctcatgtgaattaccgaaacccattctctatcacctggctgagctaaggttggttttccatatctatccgagcttgtaacaaccatggtggttgagattatgctataaataaaggtatatcctaagatcaggtaatatataatctgatatatattttttaagaatataattagcagtctatatctgaatctttaatactataagataaagttaaatattatacttcctgtattggggaaatcgaggcgaaggacggcttaccctcagcagatcgtaacaacaaggctactctactgcttacaggcccgtttcgcacagctaagtcgtctgcaaaggatttgaccccgctcgttttaaaattacaatacgcgaaatactacagcagaaaatatccaggcaggctttattggatctggcctaataccgtacgacccaaagagggttctttcaaagctagatgtggcactgcgaacaccaacaccaccagagaccctgcctgagaatgcgagtgttcgggtgtcaaacccctacgcgtaatgaaagtgaacgtaggagagagcttcggcgcatctccgaccgatgctgatgttctcggatggatttgagtaagagcatacggggccggacccgaaagaaggtgaactatgcctgtatagggtgaggcaaggagctttccattgactttcgtggatataggtccatctcgcaatccctcaatctagcaggaagctgccgatttctgtctggtcgccctcggggtagttcggcctgtgaatcggtgttctcccctgctgcctcgtctggggcagcctgatagaacaaacggtcctgtaagcagtagagtagccttgttgttacgatctgctgagggtaagccgtccttcgcctcgatttccccaatcaatccctcttgctgccggagctgatcgcccctatctacagctcccatatgatcgttataatcagcagctgcagacaagactggggcctcttttaccggctcagcaccaaagaattgcttatatgggcatgggggcgaaagactaatcgaaccttctagtagctggtttccgccgaagtttccctcaggatagcagtatggaactcagttttatgaggtaaagcgaatgattagggacccgggggctatccttaggacacctgcgttatggtttaacagatgtgccgccccagccaaactccccacctgacaatgtcttcaacccggggcggcccgcgaaggaccttaaaaccagaagttggacgtaaatccagccccgcttcattgaataagtaaaaaaacaataggtcttgttggcatcctctggcctggtaaactcgatgattaccgatgatgccgacttggttggcgatgtccgagtaagccaaccgatatatttgatgcttgcatttgggataaagggcttaccacaccaagaccactagggccggtgcggcttgggcgccccaagaggagtgctcagcgcacagcttcaaccatggcggggtccgctgcacgtggcgatctcccgttgctcagtggtaagtttagccagcggccatccatccacagaacccatccagcgacgccgcgcacggcaatccaccttccccctctcagttccccagggcatccttccaccacaccaagaccactagggccggggcggcttgggcgccccaagaggagtgctcagcgcacagcttcaaccatggcggtgtccgctgcacgtggcgatctcccgacgccgcgcacggcaatccaccttccccctctcagttccccagggcatccttccaccacaccaagaccactagggccggcgcggcttgggcgccccaagaggagtgctcagcgcacagcttcaaccatggcggtgtccgctgcacgtggcgatctcccggtggctcgatgccgaccaactcgacggatacaccctcctcgatagccacatttctcggttcttctctctcgatagcttcgatcaagcgctcgtacgatttggcacaaactgggtaaagcctccgagggctgaggtgggcacattcacctgtattgcctcagaacctaagcaattcgacggcagcatattattcatgctgatacttagacatgcatggcttaatctttgagacaagcatatgactactggcagaatcaaccaggtaactatcgttcgccctttattgggcgtggtttgtcactttttggaattttcgaccagaaaatggaaaggtactacatagcacacccagacactcgcccctgatatcacccttgctgccctggcctgtaggctctccagctttgctagagtatgtttggtatagggagctccgcatgttcgccagtggtcacttggacaggctagacggcttcggcttcgctggcgggtgattcatagtgggcgtcgaccctcacgaaagcggccgcgtatcagcgcccttctgaacaagcatctccgcgatctctagatgcccacccgctaaagcaatgtgaagagcactgccatattttccaccttgggcattaatatcagcgcccttctgaataaacatctccgcgatttctagatacccctccactgaagcagcatgaagagcattaccataggatttcttcgcaataatgaaccatccggctatcaaacacatctctccgagagaccgttggaatatggatgaagccggtattatggagggagtcagaggtaacgggctggtactaggcctaagccatagggaagttccgtttcaaaggcgcactttgcgccgtgtggcgaaagggaagccggtcaatattccggcaccagaaagcggtgataccacccgcacgtacagatggacaagaataggcttcggcttagcgtcttagcaggcgattactctccggtactagaagtgtgctgtagtatttcgcgtattgtaattttaaaacgagcggggtcaaatcctttgcagacgacttagtgccttccgagttccctggaacgggacgccatagagggtgagagccccgtacggttggatgcctagcctctgtgaaactacaaatgactaaatataccggcagttcacagggggaagatttttcatccaagcgaatggttgaagagtagtgattcaatcccgtcctcgtatcgttcccagcttccagctgtttggcccaacatcagcaatggcttatagttagtgaagttcggtacatacgcagtctgtggtgtctttagaacccagggctgccttatctcaggcagggtctctggtggtgttggtgttcgcagtgccacatctagctttgatgggcctggctggccggtccgcctcaccgcgtgtactggtccggccgggcctttccctctgtggaaccctatgcccttccctgggtgtagcggggaaacaggcgctcatcagacaccacaaaaggtgttagtacatccagacagttggacggtggccatggaagtcggaatccgctaaggactgctccgaccgatcctgatgttctcggatggatttgagtaagagcatacggggccggacccgaaagaaggtgaactatgccggtatagggtgaagccagaggaaactctggtggaggctcgcagcggttctgacgtgcaaatcgatcgtcaaatatgggcaagattaatattaaatctatattattcctaataaaaaccttctatagtagtaaatatatactatacttataaagataaattaactaataatagtcgatcctaagccatagggaagttccgtttcaaaggcgcactttgcgccgtgtggcgaaagggaagccggtcaatatcctcacgaaagcggccgcgtgcggtacgtcgtactgaggatgcctggtctggggagagctctgctctcgccggcgctggctgggttctgtggatggatggccgctggctaaacttaccactgagcaacgggagatcgccacgtgcagcggacaccgccacctcacgaaagcggccgcgtgcggtacgtcgtactgaggatgcctggtctggggagagctctgctctcgccggcgctgggtgggttctgtggatggatggccgctggctaaacttaccactgagcaacgggagatcgccacgtgcagcggacaccgccatggatgaaggcaatatatagcccccgggtccctaatcattcgctttacctcataaaactgagttcaatactgctatcctggaggctctccctctcgttgaagatgccaatgcgtatggaagtgctgtagctgaagcggttgctcttgccgcataagtggctcgattacgtgagcgcaagggagcccaagcaagtgtgttttgcatcggcctgcgccgatctgaagacgcgactaggccatgatgacaaatgcgagcccgcagaccattacacatggtgtcttggtgcgccccagctcttcaacagtgcgatagtgctgggcttgctggccatccaagagcagccaccatagccggtgttgtgatataagaaccttgccttgctgacgcacataggcacaaagaagccctcttccaaggcctaggatcgtactggtttttttgaggtgttagattttggtgtggttggcagtctgcatttcaagctcgctaacagctgcggtgttgttcgtttatccccaacacaaatggaggtctcagtggggagaccctatacccggcgaactcaaaccaaatctgccgccgccacgcagcctcgggcagggtgagaggataatgagaggatgcatagacatcgcctatttcgagctacgcccaagcagcgacaaagaaccaaacatcaaccctgcattcaaagcataggccaccatccacccacacccatctatcccttctaatcgacggtctgtagattgaaggtacctctaatactattcaatggagtgcctcataaccgcagcaggtctccaaggtgaacagcctctggttgatagaacaatgtagataagggaagtcggcaaaatagagcgacaattcccagccaatcatcggttgcttagaatactgtgaacttcatttctgattggccgtctcgctcacgtgaccattctcaccaaattgtcccgggctctagctcgactcaaggcaagatgtacatacagcagaggctcgaagcctgctaagggcatcagcacccaggtgctggctgccgccggccggttgcccggctagtggctgcctgctcccgatgcgtcctcccaaagcccaacgtacccaacccttagagccaatccttatcccgaagttacggatctattttgccgacttcaggccgttcaacccgggctcacgccctaggcttcgtcactgacctccacgtccgcctactcctcagggcatcgtttctacccaatgcacgcccgattcggctattccatacagcggctttatgattctcatgactgttccctccgggtagctttgttcaaatgattcaggcagtctcgcgtatattgcgcgttgcagattcgtctcagactgcgggtaggcctgcgtgatatctctgccggctgtggtttcgctagatagtagatagggacagtgggaatctcgttaatccattcatgcgcgtcactaattagatgacggggcatttggctaccttaagctcggggtccggtacattgtggctgggatagagggatgtctagtcgatccgcgcattgctacatgtactcgagccgccgaggagaaggggtgtgcgctcttgaccgtctggctttcagctgtcttcgccacagacctcctcgcgctactctctgaaaggaccagtcgagccctaaccctccgttacccgttgcaaccatgtttggccaatacccaaacatcgaaagttgatagggaagaaattttttcagtacagctcggttgtgactatgtatgacagtgttttgagcgccatacaaagctaacccgtagtaatgtccttctcaggcgagtgggaagaaactgatttgggcaaggctgaggacaacggggaggccttatatattcgtcgaagacagccggtgatatgcttaagttcagcgggtattcctacctgatctgaggtcaaccttggaaagttgggggtttaacggcaggggctcgttatcggtcgcgcggtttggtggccgtgagtcgatttttttgatttcccatacaaatgaattttgcggaaaatcaaaagtggatcggtcgcgcggtttggtggccgtgagtcgatttttttgatttcccatacaaatgaattttgcggaaaatcaaaactgtcccgggaactgaccgtggcgtgcaagagggtaaatgtgggccggtgtatttctgaagagtacccaggctcatgggagggtgcaccaccacccacaaaatcaagaaagagctctcaatctgtcaatcctcattgtgtctggacctggtgagtttccccgtgttgaggtacccttggcagcagccttgacaacagacataccagcaccacgctcatcaagagatctctttccactccccttcttggtacaatttttaacatcgtccgatccctagtcggcatagtttatggttaagactacgacggtatctgatcgtcttcgatcccctaattcctttctagcttgatcaaccttgttatccggcgttggagctgtttccatttaaccccaattccacttcaataggccgttattatcagcctttttcagctgtacgaggcttttgaactggggtagatacagaaggataccgagttgctagaggagttgacggcggaggcggtgtacctcttgttgagggtgaagatccaggaggcagaggaggaggcgtatcgacttggttcccggcgatgtgcatgtgctgtggttggatttgtggtggtgcatgcacgctgtggtggaatttacagtggcgtgcaggcaagcctccgcctcctcgccgtcatcgtcgccatcatccatatctctcaacttcctgattcacttgttaaaactgcaagaaatcctgaccgacgtggtggcacactacaacgacgactgtgtgagctcacagagagccgctgagcccccggcactggagcacacttctgccggcgatttctcctatggtaggcctgccacggatgcccctctacctgcctcattgtcgcctcaaccatctgatatggggttgccgggggatctccccttcgtacacttcacacgtcgaaggactaaaggatcgataggccacactttcatggtttgtattcacactgaaaatcaaaatcaagggtacttttacccttttgttctactggagatttctgttctccatgagccccccttaggacacctgcgttatggtttaacagacgcccggaagcccgatgagagtcgatacgcctcctcctctgcctcctggatcttcaccctcaacaagaggtacaccgcctccgccgtcaactcctctagaagctgaagaattgaagagaagctgaagaattgaagagaagctgaagaattgaagagaagctgaagaattgaagagaagctgaagaattgaagatcttttatctaccctacagtctatctttcttagctaccctgtagctgataaagcctctctttcctactaagtaggctgtttcttccactacgcctttcgaaacgatcccttcagtattccttggcctaccctataggctgaacctaccttagacccagacgagtcaatttttaacatcgtccgatccctagtcggcatagtttatggttaagactacgacggtatctgatcgtcttcgatacgagtcaatttttaacatcgtccgatccctagtcggcatagtttatggttaagactacgacggtatctgatcgtcttctatcccctaactttcgttcctgattaatgaaaacatccttggcaaatgctttcgcagtagttagtcttcaataaatccaagggaggatgggagtaccttggaggaatctgatcagtgggctcgcttttcattggccaggatttacgagctcattcgtacagtgggggtcatttagtatttgcccacccccttgcaacgcgttgagtattatgatgccgcttttgcgttcttcacacatcaggatcggtcggagatgcgccgaagctctctcctacgttcactttcattacgcgtaggggtttgacacccgaaccctcgcatacgaagacgactccttggtccgtgtttcaagacgggtcgttgatgaccattacgccagcatccttgcagagcagaaagagctctcaatctgtcaatcctcattgtgtctggacctggtgagtttccccgtgttgagtcaaattaagccgcagagaaagagctctcaatctgtcaatcctcattgtgtctggacctggtgagtttccccgtgttgagtcaaattaagccgcatgctccacgttatacgctgggagaagaggcaataccgagttaccaatatgccagcccggacgaggtcagtgctttcgccatagaaggagggagcaataagcatatagtcctcttcatagacgatataatactatgttaatgcgtcgtttggctcatctaacctccaatgcaactaagatctccaagcacaagtttgagctgttgccgcttcactcgccgttactagggcaatccctgttggtttcttttcctccgcttattgatatgcttacgttcagcgggtcggcggaaaccagctactagaaggttcgattagtctttcgcccccatgcccatatttgacgatcgatttgcacgtcagacccgctgcgagcctccaccagagtttcctctggcttcaccctatacaggcatagttcaccttctttcgggtccggccccgaatatgggcatgggggcgaaagactaatcgaaccttctagtagctggtttccgccgaagtttccctcaggatagcagtagtgaactcagttttatgaggtaaagcgaatgattagggacccgggggctatatattgccttcatccattctcaaactttagggtcaactgtaacaagctggtccgatccgctgtgggaaatctcttcaactgtaccgtatcttgcagattcccactgaggggtcacttggacaggctagacggcttcggcttcgctggcgggtgattcatagtgggcgtcgaccctcacgaaagcggcctagtgggtgaacaatccaacgcttaccgaattctgcttcggtatgataggaagagccgacatcgaaggatcaaaaagcgccgtcgctatgaacgcttggccgccacaagccagttatccctgtggtaacttttctggcacctctagcttcacacgtcgaacgaagaggtggcggcttggaatggatcttagcagcctctatggctacttcgagcttacctggaaacccttgcaaggtatgaaaactgccttgaaggatcgtgccaagtggccatgaatgcacgtttatgccacaccacatgtactgttggacagccagctcacgctcagtagaccggccctccctgtatctagccactgtcctcgacttacagcgcttcccaccctctaaaacaatactttaccgcggctcttaacaacttttttgattttacataccctgcagcgcccgcgggacgccctcccatgagcctgggtaggtccgaccgggcagtgccgcgaagctaccatctgctggataatggctgaacgcctctaagtcagaatccatgccagaaagggtttaatggccggaagagcccagcacctctgctgggtctggtgcgctctcgacgtcccttgaaaatccgcgggaaggaatatggacgagtgccacgtggttctggacggagtcgggcggttccggccagcgttggcagcactgggggggatcttgcagtcaagaaccggcagcttattcgcaatgagatagatcgcgatccacatatacagaaccgcgagctactattcaaggtcaataatgtctgtaaggtcggagccttgcgagccttccttcgcgatgagaaccgccgtaagtggctacaacgcaaaagaccgcttctgttagaaggcaggcttgatacgctgatggattttgacgaggagcttacaactcggtatcttgtattgtaagtcttgtcccaacttccaggtgccggaatattgaccggcttccctttcgccacacggcgcaaagtgcgcctttgaaacggaacttccctatggcttgagcgtgagctacaggcggtgagatagcctgtggggtgcaggttatgtgaggtgcaggttatgtaaagtgtaggtcatgggaggtgcaggttatgtaaagtgtaggttatgttgagtataggttatgtaaagtgtaggttatgttgagtataggttatgacttaataattactatataaattcaactccaatagctatgaaaattataccattatgatcagctcgtcgcgataattatggtggtatcggtattatcgtcattagaggttcgtggcttccgtacgcgctgcctcttcctcctcaattcgtcagctggcctgggcaggcagagtgcaccgcggagaaccacggatgatcaacctgcccaagtctggtcatgaacgcttccctttcaacctacagagtcaaacaccttgtgaggcaggtgcggcagccacgagaggaaatagccggcttcagctacagcccagattttaaacccttgaggcgtaggtttcgtagggataacaaccttctcaagggttcttccttcaaagtgctgcatacactcatctatagctatatttgtaccccttccagcccgagcgaatattcgtatctgttagaccgatcaatcgagcctttgtataacactgaaggaaggtcatcttgctgattggttaagactatgacggtatctgatcgtcttcgatcccctaactttcgttcctgattaatgaaaacatccttggcaaatgctttcgcagtacgtgcatgcaccaccacaaatccaaccacagcacatgcacatcgccgggaaccaaacttcagcacatgcacctcactggcaatgccaccaaagcatattcacacacaacacacgccacctaacctatactttacataacctatactcaacataacctacgaagaggaagaagcgaggctttggagacaactggtcatgttggcataacatggcgaagtggggcgtcacggattaactgtggcgcttcggttgtttgccggacctcgcttaccgggcatagctgcgtaattgcatagcggctaaaaccgagtaggatttccgagatcgaaggatcaaaaagcgacgtcgctatgaacgcttggccgccacaagccagttatccctgtggtaacttttctggcattacagtctgtatgcctccccactcctctcatcttcttcagccattagatgttggctgctttggaccactaaagcagtcgtacggaagagaggttgagactagaattaccacggttatccaagtagtaaggtactatcaaataaacgataacttatataatgagccattcgcagtttcgccgtataattggacgacacgaatcccaaacctctccaactcgtcttttggacctacaccgctcaacttcaggatctgtggtgtgccgaaatgcccagccgcaaggatgacctcttgagaaacgagggcatgatgcttggtgccgatggtggatgaacttgaccgaggatcctactataacttagaagagaattcctcctctattaatactaaaccatttaaactaatacattttatagatcttatttagatctacctatagggttgaagctgtgcgctgagcactcctcttggggcgcccaagccgcaccggccctagtggtcttggtgtggtggaaggatgcatcactccaccaactaagaacggccatgcaccaccacccacaaaatcaagaaagagctctcaatctgtcaatcctcattttgtctggacctggtgagtttccccgtgttgagtcaaattaagccgcaggctccacccctggtggtgcccttccgtcaatacggcgggggccccaggcagagttctcttttcttcttaacggtctatcaccctgaaatcggtttgtccggagctagggtgtaatggccggaagagcccagcacctctgctgggtctggtgcgctctcgacgtcccttgaaaatccgcgggaaggaataaaagaaatccttgacccggtcagccgtagccccattgatacgaagaagatcaattcgcttgcctcgtaacgtcttaatttccgggttccgtttcaattggattaaggtcaggcgagtaaggtggccagatcataacctctatacatagctcccttagcagagctcttacgatataggctgtatgagaaggggcattatcatgcataaagatatcccctggaccaacaatatcaggcaacatagctgaatatacaattggattaaggtcaggcgagtaaggtggccagatcataacctctatacatagctcccttagcagagctcttacgatgtaggctgtatgagaaggggcattatcatgcataaagatatcccctggaccatgcaggctgtctgcaaagtccgcgcctcgttctaccaagatgaacggctgccctcctgtagcttggacctgaatcgcatagggctcagccccatccttgccaccccgagcctgacttttctggatagcctcggttaggaatgaaagcttatcggcctcctcgaaagcggccggcccgtcacctgtggtaacttttctggcacctctagcttcacacgtcgaaggactaaaggatcgataggccacactttcatggtttgtcatttcctaccagctcttgacatttgctatacttatcaccattgttgccaacgagtagggatcattgtccttgactgcttgcccactattcaatggttcttcacaagtcaaacgatatatggtagctcttttttctttggctcattagagcgatcgtcccctatcaagcatgcagcgacaattcccagccaatcatcggttgcttagaatactgtgaacttcatttctgattggccgtctcgctcacgtgacctagttcaccttctttcgggtccggccccgtatgctcttactcaaatccatccgagaacatcaggatcggtcggagatgctccgaagctctctcctcctcgccctcatatgcctctgtgccattctcaccccctctcccttgtgcctcttcgtcgtccttgccctcgccctgctcaatggcccgttccagatggttgaggagcgctgagagggtgccttcgcgtcccggctggaagtttacacatatattgacacgagaggaaccgctcattcagataattggtttttgcggctgtccgaccgggcagtgccgcgaagctaccatctgctggataaacgagaggaaccgctcattcagataattggtttttgcggctgtccgaccgggcagtgccgcgaagctaccatctgctggctaatggctgaagatccgcaaggatactgcccgcaagttgctgccgcgatggcttggcccatacaggatagtcgatcgaagcgaacactcgaggtcttacaaattagagacaatggatggaacggcagtccgcggcacctttgcgcccgaccgtttgaaggagttccaacaagatgttcctctcgtactaagctcaattaccattgcggcgaggtcatcagtagggtaaaactaacctgtctcacgacggtctacacccagctcacgttccctattagtgggtgaacaatccaacgcttaccgaattctgcttcggtatgataggaagagccgagcaagcctacgatggctggatgaattatctccagtatcgatggttacttcccttaattggaatggaatatattgctcaagaaaccgctaaactttgtaatagtgctccgaatgaaagtttttatttatttgtaaaaactactcagaagattccaaaataaaacaagaattaagtttcctaggcgggcgcctggtccttcccgatggggtgagccgctcgcttcctgatacgttagactctcttccaacaagcacctgggttaccatacctccagtatgcagcggacaccgccatggttgaagctgtgcgctgagcactcctcttggggcgcccaagccgcaccggccctagtggtctccggagctagggtttaatggccggaagagcccagcacctctgctgggtctggtgcgctctcgacgtcccttgaaaatccgcgggcctcccatttagagcagcattcccaaactactcgactcgtcgaaggagtttcacagaggctaggcatccaaccgtacggcgctctcaccctctatggcgtcccgttccagggaactcggaaggcacgtcgccagaaacatcctctacaaattacaactctgttttaagaatgggagccatggttcatcatcattccctgctttcacctacccctggctgccgtagaacttcttcttgtcttcttgtgcacttccagcccactttctgatgctcctttccgtagtaccccctagttttacatcgcccgcatatattgcgattgaatggctcagtgaggcgtccggactggcccagagaggagggaaaccaccactcagggccggaaagctctccaacctcggtcatttagaggaagtaaaagtcgtaacaaggtctccgttggtgaaccagcggagggatcattaccgagtttacaaaaataagccgctgggcgtaataaattgtattgtattgtattgtacacaaataacccactctcgccatgaagatcctatactctgctattagcgccggtgccctcgccgcccgctccctggacccatccaccatgatggagtcgaatgcacactctagtgccagatccgcatcgctcggcttcaagcagtggtcgaggtgggtctgtgacgacttcgatctcatcattggcccggtcgagaacggggctggctggcagcgcgatgatagaaaagtcgtcaagaagctgtcggattgagaggggttgattcgacgcacagtgataatcaggtacatgaagagggcacacttttagtgtgaatacaaaccatgaaagtgtggcctatcgatcctttagtccttcgacgtgtgaagctagaggtgccagaaaaggtaccacagggataactggcttgtggtccctccgctggttcaccaacggagaccttgttacgacttttacttcctctaaatgaccgagtttggagagctttccggcttgacgcaggcgtcgctttcccacgacttgtcggaacagtagccacgaaaaaggatacccttgttcaagcaaagtcccgtcgtgatgtttccagctagaaagaacccattagttggaaacatagagtgagacgctgcaatgaatacacttacagctctcttccaagaatctgtggttgattatgtagtgggttgggtgcgctggggttggaattttagcggggtgatacacgctatggctgacttccaggtgcttatgtatactgttgtcgctaagccgaagcctattcttgtccatctgtacgtgcgggtggtatcaccgctttctggcatggattctgacttagaggcgtaatttatctctataagtatagtatatatttactactatagaaggtttttattagaaataatatagatttaatattaatttaatatctatttatatatagtcaggggagatatatcgtctcaggaagccaaatgacatccatggttgaaatcacgagaattttcaaaggtgttcatgcctctccctactgtctcccaacatggaatataccaaattggattctagagtttgtttgtccctatggcttaggatcgactaacccacgtccaaccgctgttcacatggaacctttccccacttcggtccttcaagttctccttgaagtatttgctactaccaccaagatctgcactagaggccgttcaacccgggctcacgccctaggcttcgtcactgattttaaggtattaatatctatacccaggctgaaagtataatatttaactttatcttatagtattaaaggtttagatatagactgctaattatattcagtagtgatattccgcatcggagagcgacgagcccctgccgttaaacccccaactttccaaggttgacctcagatcagggaggaatacccgctgaacttaagcatatcaataagcggaggaaaagaaaccaacagggattgccctagtaacggcgagtgtccttctccggggtcgagccctaaccctccgttacccgttgcaaccatgtttggccaatacccaaacatcgaaagttgataggggaatctcttctgcctgaattcacaatgaactggtgccaagagaggctggaagagataggatttgacgcccggattgacctgcaagataatcctgaaaaaccatttgttagggagttcttattgctgcgtgatcttattgaggcatactgcagacgacttagctgtgcgaaacggtcctgtaagcagtagagtagccttgttgttacgatctgctgagggtaagccgtccttcccaagtctggtcatgaacgcttccctttcaacaatttcacgtactttttaaccctcttttcaaagtgcttttcatctttggccgcacagacttcgagcgagctgtcgaaaaagtgacattgttccgcacaatctgtcgcaagtgggaggcaccagtcaaattcatagttcaagaggggaacaagatcgctgtccgatgcactgtcagcatgatcattggggacagcccggagcagaacaccacgtcggcaaacttgtgttttacttctcattacttctgcaattcagcgctgccctcattgatcaaataaccctaaccctaaccctaaccctaaccctaaccctaaccctaaccctaaccctaaccctaaccctaaccctaaccctgcagctagtggtcaggatcgctaacagcgatctgaccccactaacttatagtggctataatctctcaaattcaacaactttaaactactaaagcagttatatagaaaagagattaaaaagctaatatagatatatattacctatattaataagcttaagtttctctctttcttttatatagctttcttctacttcttaaatatgtaagaagctcttgttgcttaattgaacgtgagcattcgaatgtatcaatactagtgggccatttttggtaatcagaactggcgatgcgaagtctggtcatgaacgcttccctttcaacaatttcacgtactttttaaccctcttttcaaagtgcttttcatctttcgctcactctacttgtgcgctatcggtctctggccggtatttagctttagaagacgtatacctcccatttagagcagcattccagggagggccggtctactgagcgtgagctacaggcggtgagatagcctgtggggtgcaggttatgtgaggtgcaggttgtgtaaagtgtaggtcatgtgagggcgtgccgattgggtgaagtctataggtcgaaccccagatggattttgctaagggcatctgaaagctcctgcctgacctcatccttcttgcacctatacgtgtcatcaagcagacggctcattgattgcccttcgcgggccgacccgggttgaagacattgtcaggtggggagtttggctggggcggcacatctgttaaaccataacgctcacctcctcacccccgagggcacgaaagaggccagaattaccctctccacagcttcgcgtgaagcgacactgcagtgagagaaaagtgataactttcgttaccgggttcacacaaaacgcaggtgtcctaaggggggctcatggagaacagaaatctccagtagaacaaaagggtaaaagtccccttgattttgattttgtaacagaaatgcgccagatataaggcctgtgcaacgtgatgcaggcaaaatggaacgctgtgtgtaagtagagccgatgccatgggaggaactcgtgtgtcttatccagtgacagatctgggccttccatcgcgagataggcaggcagactctgcttccagatgatgagttgggcatcgagcctcatgacttctcgatatgaggctgctcgcaagccgaacgtctgttcctgaatccttccgatgactttggcgaggcggtaagagaagatcgccaatacgctggaagcatgtcttttactacggatacggaaaaatagctaatttatctaacccggccgaattgataagtgggccccgactcatagctccccggatgtgatgcatgcgtgcaccttaacctcgcgttcggttcatcccgcatcgccagttctgcttaccaaaaatggcccactagtattgatacattcggcaccttaacctcgcgttcggttcatcccgcatcgccagttctgcttaccaaaaatggcccactagtattgatacattccaatgctcacgttcaattaagcaactctctgtcaccggctacgttttcacgtctccaacatctccctcctcagcaagtcagcggaggacgcacgcagggacgcaaagctctgggccaaccgatcagaaggcgacgacacagtcgatgcagaattcccccttgatgagcgcgacgatgtgttacccgtaccggggttaggcatctctatctacctgggatgaccacacgactcatatccaacctacatatcggtaccgacaatagaggctatgaagattataaatggcttaatatcttgcaatttaatttgtctatttggaacaagagatagatgagagaagggatcaaaatatgagaaaaccactagagataaaccactagagattattcaagctgactgtgatatattagcatcatatgccttgaccttaggcgatatagccttcagggtagcttagaagagatgggatggcgggtttacaaaagtcatgtatatcggtcgcgcgggtcaaatcctttgcagacgacttagctgtgcgaaacggtcctgtaagcagtagagtagccttgttgttacgatctgctgcgggtaagccgtccttcgcctcgatttccccaatacaggcggccctggtggctggctgcgtagggggtttgggagatggacgaaggatcaaaaagcgacgtcgctatgaacgcttggccgccacaagccagttatccctgtggtaacttttctggcacctctgcgataagtaatgtgaattgcagaattcagtgaatcatcgaatctttgaacgcacattgcgcccgccagtattctggcgtgcatgcctgtctgagcgtcatttcaaccctcatgcccctagggcgtggtgttggggatcggccaaagcccgcgagcgaggttaaggtgccagagtagacgctcatcagacaccacaaaaggtgttagtacatccagacagttggacggtggccatcgccgtataattgcttatacttagacatgcatggcttaatctttgagacaagcatatgactactggcagaatcaaccacgtaactatcgttcgccggggactattccaggaatttatatatgaatccctagcaaaatcatgggctagctacacgaattacgggcttccggccaaaaaagtaggttattgagctagctttgaagagggctccttgcaacagctcttgcagccaatggcccgttccagatggttgaggagcgctgagagggtgccttcgcgtcccggctggaagtttacacatatattgacgagatgatcccttctcttggcgacaataagatcctgtctccatcccactgctgccactcgacgcctcacgtcatggagtagttgtcgtgggacagatatgggcatgggggcgaaagactaatcgaaccttctagtagctggtttccgccgaagtttccctcaggatagcagtatcgtcaaagagatccaaggtagatatcttaatatgtgcttttatcaatgaatggatcccttccgccctaagatatttattagtacctaacgtaatccacaagtgagcgggccacacaagcgagcgggccacttccttatcgtaccttaaatagcgttttttctaattgcgtacgagagtaaaccaaggtccgataacctttggatcttcgcatttagccctctgatagtcatatttccgaacccagcgcggtggtcagaataatcagcttcgcgagctctttgaaatactggccttctcacttccctccgatccgcgtggaaggcgggggaccggtttgaagttgggggttctcattgaagtatttgctactaccaccaagatctgcactagaggccgttcaacccgggctcacgccctaggcttcgtccttttgattgtcggcgctggtccagcagggtaagtcgaacctggatcagtcagtggacgaagcattgaggctgaccgtcctcgtagcctgattgattctctccgacggtctctctttggatctctctatatctcccgactttgtggcgttggcccttttgaaattctttaacatctccatatatggccagtgctgtttgaagatatcttgttggactgagcatgtaaaattagtttaagttctctatatagtttatattatatagatttaatttatatatatatattatattctaaaactatagtcaccagagagtggataaatcggatcaacaaccctctgggcttcggctgctgatgttgagattgacaagcggtgaatcatagcaaaatagataaggacaaaaacaggccctagctcgtcgtgttgaacctcggctgctcactgcttaataatgactgagtcacacccggagcgcgttatgccttttttgagaccaagggcgaatgatctttggatcctcacaaagagccctctgataatcatatttccgcgatagaactgtcttgaggaggggctgtcgctgtacaaagcgagaggcccaattgatgccaacgcgctccgcgtcgcggtcgcgtagcagtaagttcgccaccatagagctgtcctcggaccatagagctgtcctcggaccatagagctgtcctcggaccatagagctgtcctcggaccatagagctcagataaagaaagacagatgatcttagcttgccaagctatacagaaaaccccaaagctcagcatccgagcagctgcaaagatctacatggtacctcttataaaatcgagatacatttgtaaaaattacgtcgtaatgtattggctttatagcctaaaataaaaataaaaaaaaaaatgcgtttacttaaaagtcatccttttttaagattatttaatgcttatttaatagatcattcacaaccaatgcgtttcctctttgtagacctgcgtgatttttcacaagctacatttacgctagtctccttatattcgcggctcctcggggaataatcgagcaattcttcacgaacggtctctgtgctgctcccttttcgctcactgaaagatatcatagctcgcagctgttctccatcgaggaaagattggccaaaagaagatagaaatagttggaaatcaaaccagccctgataatccctccctcctcggtcttcaaactctctggcccccccccctgggaaccagctctagacatcgcctatttcgagctacgcccaagcagcgacaaagaaccaaacatcaaccctgcattcaactcgttcggcaccttacgagaaatcaaagtgcttgggctccagggggagtatggtcgcaaggctgaaacttaaagaaatggacggaagggcaccaccaggggtggagcctgcggcttaatttgactcaacacggggaaactcaccaggtccagacacaaaagagagcctatcgcgaggagcttgcgaagaaggatattctaattgattcatcaccaatcagcaagatgaccttccttcagtttattattatatagtataaataactatatataaatagatatcagattaatattaaatctatattattcctaataaaaactttctataatagtaaatatatattatacttataaagataaattaactaataactttatataactaactccccagaccaggcatcctcagtacgacgtaccgcacgcggccgctttcgggagggtcgacgcccactatgaatcacccgccagcgaagccgaagccgtctagcctgtccaagtgaccactcagtgggaattccccttgtccgtaccagttctaagttggttgttaaccgtacgccggacggccgaagcctgctaagggcatcagcacccaggtgctggctgccgccggctctctcgcagagaggatggcgatggccgatctcgatcgaacattttcagctaaggaggcagagtacttatccctgccgaacccggcggaccacgggtccgaccaccgggccatccggaccgtgtttgatgtggggacgccggaacgcaaagccagccccgcccactatgaatcacccgccagcgaagccgaagccgtctagcctgtccaagtgaccactcagtgggaatctgcaagatacggtacagttgtcgacggcctctacctgtagcgtggtcaattcgaccttgttgcagttctctgcaatgtacttgtgatatccgtttctgacattccggttctgattgatgattgacctaagaatctgttagtaggggatttcctaggtaattcctttctagcttgatcaaccttgttatccggcgttggaactgtctctatttgaccccagatccaacgcagcttgccgtttgtatcatccttcttttatagggtagcctgggtataggttaggttgtctgagaatatcctaggatttttcccggattttctagacccttatctggactagataagcctgataacctaataatagaaaaaactgatatatcaagcggctgtaatacgtgcgatgaatgcgaaggtaagaaaagaaggaatatatcgttttggaagcatttgataatgtgcatgcgttcttaggctcctacgaggcggtttcctcatttgtgcgtccaatatacctccagtctccccccagtgtagggctctctatattatgggctaatattcctatatatctctggtgttttattataaaagctatagtaaagctagttaatttaactactatctctaataaagagttaacaccctatgagttattttataaggaattagaaccttctaaaaattctaagcctaacttattgcgatggtaatagtaaatcaaccgaaagctgactgtaatacttatggcggaagaccaggaactagcgttgttggacaagataggcataattattaactatcttcgatttctgggacctgcatctggccgttaaagcttttgcttcgaggggaatatccagaggctagtcacgcattgtacctctgctacatgagaccggaaatgggaccagcctggaaagagtggaagctaaaattagctaacgctgaaattaaaacgagcccctgccgttaaacccccaactttccaaggttgacctcagatcaggtaggaatacccgctgaacttaagcatagcaataagcggaggaaaagaaaccaacagggattgccctagtaacggcgagtgaagcggcaacagctcaaatttgaaatcgggttcctagggcccgctaagccgtagcggttatagcgggctgtagccactgacccacagtggctgcagccgctattggctagtgattgttatcgctaagagatagcgatcagatgaagaataccgaacagcacaatcaaccgagccccctacggacctacgcatcggtagcggcggggaacgggctagctacaagcatacacaatccattgaaccaactcaaagcgcactcctttgatataacaaacgcacgaaggaattacttctggttcaaacctgatcgagagacaatatacctagaggaaaaggttgagaacgatgtacaaaatccacggcgaccacggcatctgactacaaactctgatacctatgcagctaacgataagagagacaggatcttattgtcgccaagaggagggaccattttgtcaatatatgtgtaaacttccagccgggacgcgaaggcaccctctcagcgctcctcaaccatctggaacgggccattgtgagtagaccacgctttctcgtcaccttcccccccttatctttcttagggtcagggggggcaggacggtccttcttcccgccgcgggttgcatagtagctcgtcgtctcgagattagaaaacaattcatgcgaaacttgctgccgaccggcttacaaggagattaggattgattgattgattaaatcctactcggttttagccgctatgcaattacgcagctatgcccggtaagcgaggtccggccaggctaccctataaccagcctaccctagactaggtcttagatcttgaataattccttcagctttaaagataagatattcaatatctggcggaccggccagccaggcccaaggttcaactacgagctttttaaccacaacaactttaatatacgctattggagctgcaattaccgcggctgctggcaccagacttgccctccaattgttcctcgttaagggatttaaattgtactcattccaattattaaaaattaattatttaagctttatattatttttagttatatttagatcagggtattagttttattaggttaggtttaatattagtatgttagagtttattttagtttaatctaaaattatacttatttgggaataagaaaagttagttatataaggttattagttaaccaatcagcaagatgaccttccttcagtgttatgcaaaggctcgattgatcggtctaacagatacgaatattcgctcgggctggaagggagtcgggggcatcagtattcaattgtcagaggtgaaattcttggatttattgaagactaactactgcgaaagcatttgcgaaggatgttttcattaatcaggaacaatccctgttggtttcttttcctccgcttattgatatgcttaagttcagcgggtattcctacctgatctgaggtcaaccgtggaaagttgggggtttaacggcaggggctcgtcgctctccgatgcggaatatcactacttcgcagaggaggccacgacttcccgagagacagaccgggcgccagaactctggcgtccttgtaatccatctcccaaaccccctacgcagccagccaccactggtttgcgagcacaaagaggctgtgctgatgtcagaaaattgtgtcataggagaaataacagactaggttggttaatgttggttaatccattatttgttaacaacaaccccactgcttccatgtgttcacaaatagtggcgcgagttattttcaggttctagtttgttggtttctaggaccgccgtaatgattaatagggacagtcgggggcatcagtattcaattgtcagaggtgaaatttagatcgtctgagaatatcctaggatttttcccggatttattagacccttatctgggcttgataagcccgataacctaacaatagctctgctggtgacccggacccctgagggttcctagggcccgctaagccgtagcggtcatagcgggctgtagccatgcgcaatacagtcgcgaaatatggtatactggaggaggacttccacaactttgatgagactggctttatgatgggcatgatctcaaccacaatggttgttacaagctcggagaggaaaagggatgatgaatacagcctcaacccgacacaggctgtggttattgacctagtgaaacggctgccgccagccatatatcacgtcttcttagataacctcttctcaagccctgacctctttacagttcttcgagaaagcaatacgggctagttagcaggttaaggtctcgttcgttatcgcaattaagcagacaaatcactccaccaactaagaacggccaaagcaatacgggctagttagcaggttaaggtctcgttcgttatcgcaattaagcagacaaatcactccaccaactaagcacggccatgcaccaccacccacaaaatcaagaaagagctctcaatctgtcaatcctcattgtgtctggacctggtgagttaatcaggaacgaaagttaggggatcgaagacgatcagataccgtcgtagtcttaaccataaactatgccgactagggagcggacgatgttaaaaattgactcgttcggcaccttacgagaaatcaaagtgcttgggctccagggggagtatggtcgcataagagagtcatagttacccccgccgtttacccgcgcttggtcgaatggcttcgctttgacattcagagcactgggcagaaatcacattgcgtcaacaccaaagcagccaacatctaatggctgaagaagatgagaggagtggggaggcatacagactgtaataatcttctgctcttaacagtaggtctcaccaaagcagccaacatctaatggctgaagaagatgagaggagtggggaggcatacagactgtaataatcttctgctcttgacagtaggtctcaaagtcagctgagtggtggctctcatggccatcattgcttgtacagagggtagaaagtaatatcaatgcatatcaatacatatcgtaggcttatccgcctcctagcagcatatggccataagattggcggtcaattgcatcaatcatttcatgttcctctggcttcaccctatacaggcatagttcaccttctttcgggtccggccccgtatgctcttactcaaatccatcctagaacatcaggatcggtcggagatgcgcctcccccccccccccccccccccccccccccccccccccccccccccccccccccccccccccccccccccccccccccccccagcgcgagtgaaatcatccggtccaggagatatagatgacaccatagtcgacgtcgtgcctcggtgacccggcgcggcaatttccaatgagttccgtcgatggcggtgtccgctgcacgtggcgatctcccgttgctcagtggtaagtttagccagcggccatccatccacagaacccattctcgtcaaagttgtataggtcctcatctaggataccgtattttgccttcagattgcgtacgagagtaaaccaaggtccaataacctttggatcttcgtatttggccctctgatagttatatttccgaacccagcgcgtacgaagctctggttaccgcttgataaagttggaagcccaccgatttcagggtgatagaccgttaagaagaaaagagaactctgcctggggcccccgccgtcgtctccgcgttcagttgcgtttatagtataaatagatataaaatataagcttttaatagcttactatctataaagtaatagttaaatagaatatttaaataaaaccctagaataatatctataagtatatattaattataaatagaataattagatataactattactaatagtataaattatataagagccgcggtaaattattgttttagagggtgggaagcgctgtaagtcgaggacagtggctagatacagggagggccgggctactgagcgtgagctacaggcggtgagatagcctgtggggtgcaggttatgtgaggtgcaggttatgtaaagtgtaggaggccatttcattgttgcctcaacaacggcctcggacgcctgacgatatgaatagaggcgcccaagacaatgacggagtccgcaccatttgtaggcctggtcatgatcgtcctgcctggcacgacggtcaatctctccgctaaggctgctattcttgctatgggaaatcaaaaaaatcgactcacggccaccaaaccgcgcgaccgatatacatgacttttgtaaacccgccatcccacctcttctaagctaccctgaaggctatatcgcctaagatactggagaaggagatgtgcgggatgtaaagatagactggctgcagggtgcactctatatcctttagccgattttctaaacgctcgaggtagctgtcccccctgcattagagtctttgcaacgagcttaatttgactcaacacggggaaactcaccaggtccagacacaatgaggattgacagattgagagctctttcttgatgttgtgggtggtggtgcatggccgttcttagttggtggagtgatttgtctgcttaattgcgataacgaacgagaccttaacaaatttgaaatctggcgcaagcccgagttgtaatttgtagaggatgtttctggcgacgtgccttccgagttccctggaacgggcggtctgtctctcgggaagcggctgcagggtagccagtctatctttacatcccgcacatctccttctccagtatcttagccgatatgctggttcaccaacggagaccttgttacgacttttacttcctctaaatgaccgagtttggagagctttccggccctgaggggtggtttccctcctctctgggccagtccggacgcctcactgagccattcaatcggtagtagcgacgggcggtgtgtacgagaattgggcataatatcgcgtctggcaggtgttcccttaacgcgggcgctaagcgtgctgtgaggtaccatgtagatctttgcagctgctcggatgctgagctttggggttttctgtagttttaaaattacaatacgcgaaatactacagcacacttctagtaccgtagagtaatcgcctgctaagacgctaagccgcagcctattcttgtccatctgtacgtgcgggtggtatcaccgctttctggcatggattctgacttagaggcgttcagccataactatcgttcgccggggttggccaccagcgcccacgaggggcactggagaattagttactgaatggcactcgtgagatctactactatagaaggtttttattaggaataatatagatttaatattaatctaatatctatttatatatagttatttatattatattatattagatattatagctataagctttaagttggaaaggaaaggtagttattactattagataataagcttcccctcttaggggctatagctatagccgggttatttatatgtacttccttaaggcccagctccttatccatttcaggttcaacaattaagaaaggggaaggtttgccattaccgccgaccattgctgcccttatgttccagaaacatcctctacaaattacaactcgggcttgcgccagatttcaaatttgagctgttgccgcttcactcgccgttcctagggcaatccctgttggtttcttttcctccgcttattgatatgcttaagttcagcgggtattcctacctgatctgagcgccagaatactggcgggcgcaatgtgcgttcaaagattcgatgattcactgaattctgcaattcacattacttatcgcctttcgctgcgttcttcatcgatgccagaaccaagagatccgttgttgaaagtttttatttatttgtaaaaactactcagctttcagcctgggtataggtattaataccttaaaaactctaataataggagctatttatacagccagatatataaataacccggctataggagacagaccgggcgccagaactctggcgtccttgtaatccatctcccaaaccccctacgcagccagccaccagggccgcccgactcatctcctcgtccttctcttggtattgctcttgcagagttttgaacccgttgagggtctgcctctcaaactcgttcaagtacgccttcatcatgccaaagacacgacggatggtgggttgcggcgggacttgtccgctaccaccctcttccgctgccatgatttgggctgataaattccaagggaagtcagccatagcgtgtatcaccccgctaaaattccaaccccagcgcacccaacccactacataatcaaccacagcccacccacaccaccacaaatccaaccacagcgaatgcacgccactgtaaattccaccacagcgtgcatgcaccaccacaattcgtatgcgagtgttcgggtgtcaaacccctacgcgtcatgaaagtgaacgtaggagagagcttcggcgcatctccgaccgatcctgatgttctcggatggatttgagtaagagcatttcccactgagtggtcacttggacaggctagacggcttcggcttcgctggcgggtgattcatagtgggcgtcgaccctcgcgaaagcggccgcgtgcggtacgtcgtactgaggatgcctggtctgggcatctaattagtgacgcgcatgaatggattaacgagattcccactgtccctatctactatctagcgaaaccacagccaagggccctagctccggacaaaccgatttcagggtgatagaccgttaagaagaaaagagaactctgcctggggcccccgccgtcgcttctagaaatgcagggaagaaatcttcctttgtaatataggtaatccgtgccttcataagatgctcaatttggcggccataggctgttttgggctggatttacgtccaacttctggttttaaggtccttcgcgggccgacccgggttgaagacattgtcaggtggggaggttggctggggcggcacatctgttaaaccataacgcaggtgtcctaaggggggctcatggagaacagaaatctccagtagttattagttctttagattttaatagtttaataatataattaaagaatattaattactatagttattctaatactaaaactatcgcgatgattttatcttcgtatcgcaaaatcgtctcttttcggaacttcgggaaagcgacctttggagcgaagggatggttgtgatcggtggtctggccaggttcgataatatcgcgatgattttatcttcgtatcgcaaaatcgtctcttttcggaacttcgggaaagcgacctttggagcgaagggatagttgtgatcggtggtctggccaggttcgataatataggcccctgacccggagcttttaatccacaacctgaaaggacaagcgggaggcccaattgatgccaacgcgctccgcgtcgcggtcgcgtaacagcaaattcgccatatcttgcacctcactcaatcgaggagaaaatgcttatctccttctccagtatcttaggcgatatagccttcagggtagcttagaagagatgggatggcgggtttacaaaagtcatatctccttctccagtatcttaggcgatatagccttcagggtagcttagaagagatgggatggcgggtttacaaaagtcaggtatatcggtcgcgcggtttggtggccgtgagtcgatttttttgatttcccatacaaatgaattttgcggaaaatcaaaactctcaccatgatcatgcaagcacccggccagttacagggcacctaccctactaaaacaacccacaacagtatacatacgcaactggaagtcagccatagcgtgtatcaccccgctaaaattccaaccccagcgcacccaacccactacataatcaacaaaagtcatgtatatcggtcgcgcggtttggtggccgtgagtcgatttttttgatttcccatacaaatgaatttttcggaaaatcaaaagacagtggctagatacagggagggccggtctactgagcgtgagctacaggcggtgagatagcctgtggggtgcaggttaggtgaggtgcaggttatgtaaagtgtaggtcatgtgaggtgcaggttatgtaaagtgtaggttatgttgagtataggttatggcccactagtattgatacattcgaatgctcacgttcaattaagcaacaagagcttcttacatatttaaagtttgagaatagaccgcatgctgtaccaaatcacgcaaaagacattgctcgatccaatgcatcctctcattatcctctcaccctgcccgaagaccgcatgctgtaccaaatcacgcaaaagacattgctcgatccaatgcatcctctcattatcctctcaccctgcccgcggctgcgtggcggcggcagatttggtttgagttcgccgggtatagggtagctggcctcctcgaccgccagtggtataaccaacaccagtaggtcggtttggtggagggcgaggaacgttgggaggaggcttcgctctctcatcaagagatcgtcggcctcggcctccagcatatcgcttggcggcaagacgaacccgatggttcagagtccgtctgcgaagagacttgtgatttgatcttgcggaagaaaagggatatcgctccgtgaacaagaggtcaggatcagatgaagaagcgacgagaatatccatgatgggccgggtttgaagagagctgtaagtgtattcattgcagcgtctcactctatgtttccaactaatgggttctttctagctggaaacatcgattgcacgttttggagaagcaccctcgattgtggttcataatgctggctgggcattcaaccagaggctgttcaccttggagacctgctgcggttatgagtacgacctggcgtgagaattattccttcccgcggatttgatttctgcccagtgctctgaatgtcaaagcgaagccattcgaccaagcgcgggtaaacggcgggagtaactatgactcgcttaaggtagccaaatgcctcaaccccggcgaacgatagttacctggttgattctgccagtagtcatatgcttgtctcaaagattaagccatgcatgtcgaagtataagcaaaaagtcatgtatatcggtcgcgcggtttggtggccgtgagtcgatttttttgatttcccatacaaatgaattttgcggacaatcaaaaattcatccaccacatacgaccatacccattcgaaaacacgcgatcccgtccgctctcgcctagttaaacggatgaggggtggattagtagttgggtcggtgacgaccagcgaattctcaagtacacagcattccggcccgcacggcactttccttcccgcttgtgctcatcagactgtccgctgtcttgaagcatctgccccagaattccgaaattgcgatgatataatgctgagtgtatgattcataccgggagggcaagctttagctttagcttgtgcagcaggagaaaataccactagattattttttttatactaaataataaaaatattattaataatattataaaacaacatacaataatcataaaatataaacctgggaagaagtcagccaattaaagaacttcttgatggcacactcaggctgcaatgatgcaaatattgatcagtggattcaaggtgaagccaggcaatctttccaaggttgacctcagatcaggtaggaatacccgctgaacttaagcatatcaataagcggaggaaaagaaaccaacatatttaaattctttaaatatatatataatagctataaattccttattataaatagagtaattaagttctatactatatagtttctttaagagaggataatgagaggatgcattggatcgagcaatgtcttttgcgtgatttggtacagcatgcggtctttattgggcggggtttgtcactttttggaattttcgaccagaaaatggaaaggctggtttgcgagcacaaagaggctgtgctgatgtcagaaaattgtgtcataggagaaataacagactaggttggttaatccattatttgttaacaacaaccccactgcttccatgtgttcatcctgcctcgttcgtttggaagtcgaaaaatttatgactttccatgatacccgcattagcaatgacaatgtccacacgctcaaatttactgatggtggaagtaaacagagcggctacatcgtcccaatcagtaatatccacaggcacgaacatggtgcgcttaggatcgactaacccacgtccaaccgctgttcacatggaacctttccccacttcggtccttcaagttctcattgaagttttgacgatcgatttgcacgtcagaaccgctgcgagcctccaccagagtttcctctggcttcaccctatacaggcatagttctcatcgcgtactgctgccaagtccattcccacacctacacctgcatcaagtattccctgaagggcctcgcaagccgggatgcagataagtacaggcggacggcctgtcggttcaaggcgccctggaagatcgtggatgcgacggggctgagcgaggatacacgtcctattttattattccatgctaatgtattcgagcaaaggcctgcctggagcactctaattttttcaaagtaaaagttttttgatttcccatacaaatgaattttgcggaaaatcaaaagtggcccgggaaccgaccgtggcgtgcacgagggtaagtgtgggggggcctctctcttttctgttatatcggggttggggggttgggggcctctctcttttctgttatatcggggttggggggcctttctcctttctattatatcggggttggggggtatttccgtcagtgtagcgcgcgtgcggcccagaacatctaagggcatcacagacctgttattgcctcaaacttccatcggctttagcccgccaatacccagggccttgccattggcggagttgatgacggtgatgaggtccggaacagccgcaatcactgcctcacttccatcatgctttcgtgagggtcgacgcccactatgaatcacccgccagcgaagccgaagccgtctagcctgtccaagtgaccactccgtgggaatctgcaagatacggtacagttgaagagatttcccacatcgaaatagagatactacaatttaaaatacatggcgagcggggtcacaatgtactcgttttgcactggagctgaaattcacaattcttggcaatctcctccgtatcgggcatgttggaccatctcaaattcaaaagaaaacacaagtccggcataaaagaagtcagccatagcgtgtatcaccccgctaaaattccaaccccagcgcacccaacccactacataatcaaccacagcgcaccccttcgcgggccgacccgggttgaagacattgtcaggtggggagtttggctggggcggcacatctgttaaaccataacgcaggcttcgcgggccgacccgggttgaagacattgtcaggtggggagtttggctggggcggcacatctgttaaaccataacgccgggttgcgaagctgacaagaagtgaaagatcaaggatgactgtgtaagggtaatcaatatacatgtgtgctgacgatctctatcccacaaccctgttattataaggcaccatctctcggaattcttcatccacaagggcctcacatctagttggaaaagcctcctccttttcttattccagcttgttaggttaatccagttgcactatggaccgtttccaggatatcaagcgcaacaaactccccgacgtctatgatgcggcagcagttccaagtgtatgttatgttgagtataggttatgtaaagtgtaggttatgttgagtataggttatgtaaagtataggttaggtggcgtgtgaaaaaaagtcatgtatatcggtcgcgcggtttggtggccgtgagtcgatttttttgatttcccatacaaatgaattttgcaaaaaaagtcatgtatatcggtcgcgcggtttggtggccgtgagtcgatttttttgatttcccatacaaatgaattttggggcctcagggtagaaacgatgccctgaggagtaggcggacgtggaggtcagtgacgaagcctagggcgtgagcccgggttgacctcagggtagaaacgatgccctgaggagtaggcggacgtggaggtcagtgacgaagcctagggcgtgagcccgggttgcacgtatctgatgctccttgcagaatagctcgaattctgttgagtggtggctttcgtgtccatccatgattagaagacgatatacgccttaagttcgcggcttagtatgcttttcaaagtgctggatccattctacacccttttcatttgacgtccagccgttgtgagttgtggagatgacccaatagatgacgaggcatttggctaccttaagagagtcatagttactcccgacgtttacccgcgcttggtcgaatggcttcgctttgacattcagagcactgggcagaaatcacattgcgtcaacaccactaggatagcagtattgaactcagttttatgaggtaaagcgaatgattagggacccgggggctatatattgccttcatccagtctcaaactttaaatatgtaagaagctcttgttgcttaattgaacgtgagcattcgaatgtatcaatactagtgggccacacccaacccactacataatcaaccacagcgcacccacaccaccacaaatccaaccacagcgaatgcacgccactgtaaatgcaggcctttgctcgaatacattagcatggaataataaaataggacgtgtggttctattttgttggtttctaggaccgccgtaatacttatttagaaataagaaaagttagttatataagattattagttaatttatctctataagtatagtatatatttactattctccagtgcccctcgtgggcgctggtggccaaccccggcgaacgatagttacctggttgattctgccagtagtcatatgctagggctcgaccccggagaaggagcctgagaaacggctactacatccaaggaaggcagcaggcgcgcaaattacccaatcagaggaggaattctcttctaagttatagtaggaagaggtaaagagagattaggggaaaagggttatttattcaattaacaccacttttaaataaagatctattataagaatattatttttagatataaaataataaaataagtatagaaaaggtttaatgaaaagagggttaaaaagtacgtgaaattgttgaaagggaagcgttcatgaccagacttgggcaggttgatcatccgtggtcaaccagaggctgttcaccttggagacctgctgcggttatgagtacgacctggcgtgagaattattccttcccgcggagtttcaagggacgtcgagagcgcaccagacccagcagaggtgctgggctcttccggccattaaaccctagctccggacaacacctccaaactgccaactaccggcagccaagtctgtctcgttcccatcgagccatctctcgggcttgaagctcagggggtcctcaaaatagtccggattctcggagatactggcgtgatttatgacgaaacttgttcctcttgggaaataataaccctcaccggcgccgaagctcccacctattctacacctcctatgtcttttcacaatgtcaaactagagtcaagctcaacaggggcttctttccccgctgattctgccaagcccgttcccttggctgtggtttcgctagatagtagatagggacagtgggaatcgcaaggcaagctgtcgaattgataccagatgaccatgccgaccaggcaggctggttgaacaaccttgggaacaagcttgagagccggtacgagcggacaggcgcacctctagcttcacacgtcgaaggactaaaggatcgataggccacactttcatggtttgtattcacactgaaaatcaaaatgcattggtttttaatctaataaatacatcccttccgaagtcgggattttaagcatgtattagctctagaattaccacggttccaacaaaatagaaccacacgtcctattttattattccatgctaatgtattcgagcaaaggcctgcctggagcactctaatgaagggcatagggttccacagagggaaaggcccggccggaccagtacacgcggtgaggcggaccggccagccaggcccaaggctgtgatccaaggggtaaatgcagctggctgggctatccctcctttcatcatcctagctgcccaatatcatcttgagaattggtatcgggaatgcaacctgccgtacgattggcggcttacaacaactgagaatggctggactactaatgaggttggtctagattggattaagcactttgattcctatacagctcctcgtacgaagggggtatatcgaatgctaatccttgatggccatgagagccaccactcagctgactttgagacttattgtcaagagcataagattattacagtctgtatgcctcctcactcctcccttagaggagttaatgctgctgctgtcgggctcatctatactgcggtctatcgtctctggcagattggctacattgataagggattccagcagggaaccagcctagcggttgaaccgtggtgggtggttgtgacggccacgagctacgtaggtggctagctgagggtaagccgtccttcgcctcgatttccccaatacaggcggccctggtggctggctgcgtagggggtttgggaggtggattacaaggacgccagagttctggcgcccggtctgtctctcgggaagcggctgcagggtagccagtctatctttacgctgagggtaagccgtccttcgcctcgatttccccaatacaggcggccctggtggctggctgcgtagggggtttgggagctggattacaaggacgccagagttctggcgcccggtctgtctctcgggaagcggctgcagggtagccagtctatctttacctatgaccgctacggcttagcgggccctaggaaccctcaggggtccgggccaccagcagagctattattaggttatcagtcttatctagcccagataagggtctagaaaatccgggaaaaatcctaggatattctcagacgatctaacctatacccaggctctcatcatttgctttacccttatttgttctttcctgtcttgtcctattttcccccgtcttcctttgctttatctcttccttattcttccagttcttatacttttcatccaagtatcattgcgaggtggtcaagatggttcgtctcagtgccgtctcttcgttactggcgctcacgagtgccattcagtaactaattctccagtgcccctcgtgggcgctggtggccaaccccggcgaacgatagttacctgggcgcccgccagtattctggcgggcatgcctgtctgagcgtcatttcaaccctcatgcccctagggcgtggtgttggggagcggccaaagcccgcgagggacggccggcccctaaatctagtggcggacccgtcgtggcctcctctgcgaagtagtgatatgcgcccgccagtattctggcgggcatgcctgtctgagcgtcatttcaaccctcatgcccctagggcgtggtgttggggctaagtcgaaaagctctacatgttggcgcggtgatgcgtgaaccaagactggttcaagtgtcacttcctgctggaggcgactaaggaacgaatccggctacgagagagctctccctattctctctaaccgctctttcgctgaaggccgagtcacctcaccagcaaagacgattagcctccagaggccatccgatttcaaggcatcttcagggtagaaacgatgccctgaggagtaggcggacgtggaggtcagtgacgaagcctagggcgtgagcccgggttgaagggcctctagtagcatatgactactggcagaatcaaccaggtaactatcgttcgccggggttggccaccagcgcccacgaggggcactggcgaattagttactgaatggcactcgtgagagcgcgccgaacagcatatgactactggcagaatcaaccaggtaactatcgttcgccggggttggccaccagcgcccacgaggggcactggggaattagttactgaatggcactcgtgagagcgcgccgaacacagcaccagcggcagggccaccgacgccgcgcacggcacccattaatcattacggcggtcctagaaaccaacaaaatagaaccacacgtcctattttattattccatgctaatgtattcggcatcttgtcgatgaggtcttccaacacctcttcgcttgcattatcgggaaggcgccacttgggatacaagttcatgtgcggaggctggatggggcgcccaagccgcaccggccctagtggtcttggtgtggtggaaggatgccctggggaactgagagggggaaggtgggatcgccacgtgcagcggacaccgccatggttgaagctgtgcgctgagcactcctcttggggcgcccaagccgcaccggcggtcctagaaaccaacaaaatagaaccacacgtcctattttattattccatgctaatgtattcgagcaaaggcctgccttgagcactctaattttttcaaagtaaaagtcctgtttccccgctacacccagtgaagggcatagggttccacagagggaacagccagcatagaggttggagagctattttgatgagctgagattcgggatttaatatgctcagactgtatgcttgcctcatacgcagtctgtggtgtctttagaacccagggctgccttatctcaggcagggtctctggtggtgttggtgttcgcagtttggtccatccagaggtggagaagtggctacccgaggccgacatgttgaggggggatgactggaggctcttggcagaaaacaagcatatccttgagctgttccatctgcagaccatgagaacgcaggggtggggtagcgagggaggtaatggacgactttgggaggtgatgacaggcctgaaaccatgcaatgcatcccaagatagttaaaagtagatcggttcctgcatgctagcttgcggtagttcacgtgggcgatggcagggcagggcaagtctcgtgaaaggttattctcattctcttgttctactcgtggatggataaacccgcgcattgcacaaggcaagcgagaccagcaaaagggtcaaagcacgatacatgctcttgctaatgagcttgaagcagaggggttttggagtcgaatacgcttcgtgggtaatttgcgcgcctgctgccttccttggatgtagtagccgtttctcaggctccttctccggggtcgagccctaacgctccgttacccgttgcaaccatgtttggccaatacccaaacatcgaatgcgcgactgatggtagcaagaatcgcaattactgtgttaagggtgaggcccatgggccattttggcataggtcgtccatcatagacagtgaggatgaccgaggagtggttataccccagatcatgtatgcatgctccgcgtggtccaacgccaactggagaacacaaaacatgccacatactactaaaacgctggagggactgcaacgcctgcaagcacgagcggccagagtgataaccggtgctttcaaagccacatcagcggctgcagccactgtgggtcagtggctacagcccgctatgaccgctacggcctagcgggccctaggaaccctcagggggccgggccaccagcagagctattattaggttatcgggcttatctagcccagataagggtctagaaaatccgggaaaaatctcgtgagggtcgacgcccactatgaatcacccgccagcgaagccgaagccgtctagcctgtccaagtgaccactcagtgggaatcgtgagggtcgacgcccactatgaatcacccgccagcgaagccgaagccgtctagcctgtccaagtgaccactcagtgcgaatctgcaggatgactgtgtaagggtaatcaatatacatgtgtgctgacgatctctatcccacaaccctgttattataaggcaccatctccttggtgcagctaagggagcagtatgtaccttacaggggtatgattggctggacagagcaaataatccctgacaggatgactgtgtaagggtaatcaatatacatgtgtgctgacgatctctatcccacaaccctgttattataaggcaccataactattctacgctcggaaatcatcactatacttcccgaaacgaactagatcagtctttcaggtctttcagtgcaactagcgggctgtagccactgacccacagtggctgcagccgctattggctagtgattgttatcgctaagagatagcgatcttaaccgctattggctagcgttagcagggggttattagcggttgtggccagtggccgcaatcgctagaagctagtggttacagcctgattcatcagctctcgggcattccacataaaatctgaggcccaaccgtaataaatatattgtaaagatccatcctagacatgcaagtatcgcattcctcaatgatcttctgtagtaatatagtgttttaaacggctataaataagcatttaaacttacaagcagctgcaactgtatgcgttgtcatgacgcgtttgtcttgaacagaccacttcttcgttccatccgggtcatgctgttcaacgtaggtgaaagctgcctcggctagccactgtttgaacggcttattgctgtgcgtctgtcgagaacccgatatggcgtgccgttggtagatcacgagttcatggagagaaacagctcgttttttttacacttttgaggggccgctaatggcctgtagtcatccacatctattgatggcctgagctttagagttcagctttaatatattattttataattaaattagaataagtatttaatataataaatttattttctattaaattactagattatagtaaaatattaaatattcttataatctatatatattttaattttatatagatccaggcagctaccaagaatttgctgctccattcatcgtccaactccgcgagaacctcaagcgcgtcttccagcagtactggcgtacaccgatatacatctactccaagatggctctttgcacgattatttcttctgtgtggcaatagacgtaggaaaatgacaagtgattgttccagtttgagttgaattatggccaatggtggctataagcagcgctgcccacaaatcaaatgcaatcaaacaaacagccaaacaaatcaatcaaatatgccagaatcttatctcaaatcgcgaagagagtcagagcgaccatcttgggctgggaagtgtttgttcaaatggttgcagtgagtttttttttttttttctttgtgaatgatagtgcggtgttgaagaggaggaaaaacgcgtagcaggaaaaagggcgggttgacctaaattcgcgatcatttcctccccggcttagtggtgtgcaagatatggcaaatcgactgctcgctgatcgcgacgcgcctctcgcgcttctacacgtttatcttctgccttattccagtctaggtatgctatcatctcctccttagtccactcccggctagattctgttgctgtgcatcgtttacccatctgcttatagtccaaacaccaattataacttgctttatcgtagcgttgaggataagacgaggacgatcaagatagaaaagaccaggctgatggtaggtaggctagtcacaaagtaaagggattgacgttttgcaaaagggggcaatggttaatttatagtaggaggagcttggtgatgcttctcggggttcttcctttactgctaagatcttgtaattggaatgagtacaatttaaatcccttaacgaggaacaattggagggcaagtctggtgccagcagccgcggccgttactagggcaatccctgttggtttcttttcctccgcttattgatatgcttaagttcagcgggtattcctacctgctctgaggtcaaccttggaaagttgggggtttaacggcaggggctcgtcgctctccgatgcggaatatcactacttcgcagcatcgatgaagaacgcagcgaaatgcgataagtaatgtgaattgcagaattcagtgaatcatcgaatctttgaacgcaattcatggatacttatagaaagttatcagacacggctcgtcgggaagaatttgcaggctgaaccccgtgggggtagtcgtaaggtacgtctctctgccgagactagactggactggcgccacggaatttcatcttttcggctagccgtgcgccgactttagttaaatcaatgcattgatgccaacgcgctccgcgtcgcggtcgcgtagcagtaagttcgccatatctgccacctcgcgtaatcggggagaaaaggcttgggaatctagatcaagaatcctctgaagaacaacgtcttcctctaagattgtaagcttccgtgttttgatggcaaactagccgggcaaccggccggcggcagccagcacctgggtgctgatgcccttagcaggcttcggccgtccggcgtacggttaacaaccaactactagccgggcaaccggccggcggcagccagcacctgggtgctgatgcccttagcaggcttcggccgtccggcgtacgggtaacaaccaacttagaactggtacggacaaggggaatctgactgtctaattaaaacatagcattgcgatggccagaaagtttttaacatcgtccgatccctagtcggcatagtttatggttaagactacgacggtatctgatcgtcttcgatcccctatcattaatgccacgacggttcctagtaggatccgttgaaatttggtgggtgaattttcacgctactaaaaggtccacttttatctgaaagaggctcttaagctgatcagttgagtatagatattgaatatcttatctttaaagctgaaggaattattcaagatctaagaccttctcaatacggtcaaaaagcaagcctacggcagaggaaccacacgggagacataaatacgcctgttttacagcatattcgcgtccgacgaaagagcccgggccgctgtgcagcctgcagaggtgtccattcaattggattaaggtcaggcgagtaaggtggccagatcataacctctatacgtagctcccttagcagagctcttacgatgtaggctgtatgagcaattggattaaggtcaggcgagtaaggtggccagatcataacctctatacgtagctcccttagcagagctcttacgatataggctgtatgagaaggggcattatcatgcataaagatatcccctggactaacaatatcaggcaatatagctgaatatattaagcaacaagagcttcttacatatttaaagtttgagaatggatgaaggcaatatatagcccccgggtccctaatcatgcgctttacctcataaaactgagttcaatactgctatcctgagggaaacttcggcggaaaccagctactagaaggttcgattattagattaaaaaccaatgcccttcggggctctctggtgattcatgataacttctcgaatcgcatggccttgcgccggcgatgggtgagacgcttgagcgccatccattttcagggctagtacattcggttggtgagttgttacacagtccttagcggattccgcatccaggtgccggaatattgaccggcttccctttcgccacacggcgcaaagtgcgcctttgaaacggaacttccctatgcatccaggtgccggaatattgaccggcttccctttcgccacacggcgcaaagtgcgcctttgaaacggaacttccctatcgcttaggatcgactaacccacgtccaaccgctgttcacatggaacctttccccacttcggtccttcaagttctcattgaagactggctaccctgcagccgcttcccgagagacagaccgggcgccagaactctggcgtccttgtaatccatctcccaaacccccaccctctaaaacaataatttaccgcggctcttaacaacttttttgattttacataccctgcagcgcccgcgggacgccctgagagtgggggcttaatcacggtgaggacagcttatctcaccattgctgatgtttcagaatggttctcatacgtctacgtagtctagaagcttcttttgctgtcgcttatcaatctacgttgccatcgtctccttcgtgcctcttattagtatatcctctattatacgatcatgacactcctcagcaacgcactaggggaaacctggctctatcctacagccaccaaggccgttatgaggaggctgaagcactagaggagcgagtgacgtcacattccggatgggctaaagtgtagtatcgtaggtacaccctgtggtgatatgaagagatctgtatccagcaccttcgagtggcctcattgcgtcaattctaggcaggaagtctccaagcttatgaagtaatgaaggccgaagtattgggctggatgtaagggtctaataaatccgggaaaaatcctaggatattctcagacgacctaacctatacccaggctaccctatagccagactaccctagactaagtcttagatcttagataattccttcagctttaaagataaggtatctaatatctatactcaactgaaacaccggcggcagaaacttggccggtgatagatggtgggagggagccaggagagatagttatgcatgaggagggtatgtaccgcaactaagagtaatcgcctgctaagacgctaagccgaagcctattcttgtccatctgtacgtgcgggtggtatcaccgctttctggcatagagtaatcgcctgctaagacgctaagccgaagcctattcttgtccatctgtacgtgcgggtggtatcaccgctttctgtcatggattctgacttagaggcgttcagccattatccagcagatggtagcttcgcggcactgcccggtcggacagccgcaagcctgcggcttaatttgactcaacacggggaaactcaccaggtccagacacaatgaggattgacagattgagagctctgtcttgattttgtgggtggtggtgcatggccgttcttagttggtggagtgatttgtctgcttaattgcgataacgaacgacacagcaaatgttctgatacctgcacttgccccccgaactcagaacccaacccaaacccgctgcggttaacccttctccgtctggagcggatgggaaacggtggctaatccgacgggagagcagggatacatccgcgcatgaatggattaacgagattcccactgtccctatctactatctagcgaaaccacagccaagggaacgggcttggcagaagatggatgggtcagggccagggccatgcgaggcaggtgaggcagcgtgtgatgtatgtgccagggctaggcaggcaacagggtctttaagtttcagccttgcgaccatactccccctggagcccaagcactttgatttctcgtaaggtgccgaacgagtcaatttttgctgtaatacgtgcgatgaatgcgaaggtaagaaaagaaggaatatatcgttttggaagcatttgatcatgaattcatcagttgtatgacttccgtggccatcaaggataagtaacctaggtctcttggtctcgggcttcgtcaacgggatgaagatcatagaaacgatgccctgaggagtaggcggacgtggaggtcagtgacgaagcctagggcgtgagcccgggttgaacggcctgtagtgcagatcttggtggtagtagcaaatacttcaatgagaacttgaaggaccgaagtggggaaaggttccatgtgaaccgaacttccctgctgcgttatagcggtctcaaggcccaatacaccttgaaggccactgtaatttcaacacttattactaactacctcttataatagtaataatagatacctcttgttatgcttcaaaatgactgttagggtccttgaagtataatctcttgttattaagctatttaggttatctaggcagctccgaatgctgtaccaaatcacgcaaaagacattgctcgatccaatgcatcctctcattatcctctcaccctgcccgaggctgcgtatagggtaactcgctctgcagcaagcctcaaaccttgcctctatagaggttaaaattgctgtgcactgatgcacccaaagctagaagggagtctggcctttcgcatgaactttcggaattcctggataacaagagcttgagcggggttatctttgtactctcgcgacgggtcatcgatgagagactcgtcagattgcttccatcggcctccagttatctgctgtttgacatcaataagagcgtttctggtcccggttcccccaaggggaggtaggtcggttccaaggggtgtatcctctcttgaagggagtctggcctttcgcatgaactttcggaattcctggataacaagagcttgagcggggttatctttgtactctcgtgacgggtcatcgatgagaggcgtcggtggccctgccgctggtgctgtgttcggcgcgctctcacgagtgccattcagtaactaattctccagtgcccctcgttatttaatttaacttttctatttaataaactttctaataattctattctatttaattctcttctatctaataatactaactaaaatagatattaaaaaatttttttaccacgatttcattttcaattcaacgtagtataaccctacgaaaactcctcaatgacgctacgcggctccttgtacaaaattcatttgtatgggaaatcaaaaaaatcgactcacggccaccaaaccgcgcgaccgatatacatgactttttttcaagtggtggtccaaaattcatttgtatgggaaatcaaaaaaatcgactcacggccaccaaaccgcgcgaccgatatacatgacttttttttaagtggtggtcagaataatcagcctccctccccctaaccctatactgctctaaaatactctctaaccctaaccctaagtaaccctaatatcccctccccctaactatgcgacacaatcagaatgctcgttcaacacatgtttcctgaactgattgagatgaccgtgtttatgtatgctgaaagattaccccctgccgattgggctggtggagtgtgctcgctggaagattgtagtgggacggactactacaagcggtatgcaattcttttcttcttaacggtctatcaccctgaaatcggtttgtccggagctagggtttaatggccggaagagcccagcaccgctgctgggtctggtgcgctctcgacgtcccttgaaaatccgcgggaaggaataattctcacgccaggtcgtactcataaaatggctcagtgaggcgtccggactggcccagagaggagggaaaccaccactcagggccggaaagctctccaaactcgggcatttagaggaagtaaaagtcgtaacaaggtctccgttggtgaaccagcggagggatcattaccgagtttacaactcccgacgactttgggaggtgatgacaggcatggaatacttgctggaacacctggaagatcggaagctgttctatcaggctgccccagacgagaatgaaccatcgccggcgcaaggccatgcgattcgagaagttatcatgaatcaccagagagccccgaagggcattggtgtttaatctaataaatacatcccttccgaagtcgggattttaagcatgtattagctctagaattaccacggttatccaagctaattagtgacgcgcatgaatggattaacgagattcccactgtccctatctactatctagcgaaaccacagccaagggaacgggcctaattagtgacgcgcatgaatggattaacgagattcccactgtccctatctactatctagcgaaaccacagccaagggcacgggcttggcagaatcagcggggaaagaagaccctgttgagcttgactctagtttgacattgtgaaaagacataggagtgttgtgtgccacatatggcataattcaagctctcctccactcgaatgaagcagtgtccaagtccagaagccacatcgagtcctcgcccttggttggcctttcgctcttccaatgaatacaagacaatttcgatccctgaaatccctgaagccaggcaacaccaggcatttcgccctccataccaactgacataccccaccggcccacatttaccctcttgcacgccacggtcagttcccgggccagttttgattttccgcaaaattcatttgtatggtaaatcaaaaaaatcgactcacggccaccaaaccgcgcgaccgatatacatgactttttttgaagtggtggtcacccaagaggagtgctcagcgcacagcttcaaccatggcggtgtccgctgcacgtggcgatctcccgttgctcagtggtacgtttagccagcggccatccatccacagaacccatccagcgccggcgagagcagagctctccccagaccaggcatcctcagacatccgcaaaaaccaattatctgaatgagcggttcctctcgtactaagctcaattaccattgcggcgaggtcatcagtagggaataataaaataggacgtgtggttctcttttgttggtttctaggaccgccgtaatgattaatagggacagtcgggggcatcagtattcaattgtcagaggtgaaatccccgactgtccctattaatcattacggcggtcctagaaaccaacaaaatagaaccacacgtcctattttattattccatccccgactgtccctattaatcattacggcggtcctagaaaccaacaaaatagaaccacacgtcctattttattattccaggctaaaagttataattggtgtttggactataagcagatgggtaaacgatgcacagcaacagaacctagccgggagtggactaagcaggagatgatagcatacctagactggaataaggcagaagataaacgtgtagaagcgcgggttgctgaggagataaggaatatttaaagtttgagaatggatgaaggcaatatatagcccccgggtccctaatcattcgctttacctcataaaactgaggtcaatactgctatcctgagggaaacttcggcggaaaccagctactagaaggttcgattagtctttcgcccccatgcccatggtttcccagagcggtcagaaaatccttcgaactaggataaagtagaggatacagaatcatgcattggaacttacttgcagattcccgggccgattcgcactcatcgatgcattcatcaagcgctctggacagtgtcctaaagtacacaccaaccctcaaaagcgccctggatagtttgttccgtcattgcagctttaaatgcggtgaaaaacgcgggtaggaagtccgccttcgttatgtgtgtaatccccgctctcattatcccttcaatttctttaccataggtaacgagattcccactgtccctatctactatctagcgaaaccacagccaagggaacgggcttggcagaatcagcggggaaagaagaacttccctatggcttaggatcgactaacccacgtccaaccgctgttcacatggaacctttccccacttcggtccttcaaaacttccctatggcttaggatcgactaacccacgtccaaccgctgttcacatggaacctttccccacttcggtccttcacgttctcattgaagtatttgctactaccaccaagatctgcactagaggccgttcaacccgggctcacgccctaggcttcggcctttatcccccggggcgaactgatgctggcctgggcaggcagagtgcaccgcggagaaccacggatgatcaacctgcgcaagttgtggttaaaaagctcgtagttgaaccttgggcctggctggccggtccgcctcaccgcgtgtactggtccggccgggccgttccctctgtggaaccctatgcccttcactgggtgtagcggggaaacaggacttttactttgaaaaaattagagtgctcggctttcgccttcagcactcgcgcccctctctcataggtgcaccgacccacatttaccctcgtgcacgccacggtcggttccctagtaagaaagagaggctttatcagctacagggtagctcagaaagatagactgtagggtagataaaagagtgaattggtggcttaaagaacctctatctagcagggaggaagccctgttcttcgagagcagtcaaggtgccgatacagacccgtcaactgaggaatctgaccggcccaagcgacggcgcttgcagtacagcagtttcagccttgcgaccacactccccctggagcccaagcactttgatttctcgtaaggtgccgaacgagtcaatttttaacatcgtccgatccctagtacgttcactttcattacgcgtaggggtttgacacccgaacactcgcatacgaagacgactccttggtccgtgtttcaagccgggtcgttgatgaccattacgccagcatccttgcagagcgcgaacctcagtccaccccagggtattacacagtgggctaccgttgtggtgggccgcgaggaacgggaacgatgcggtggtcgcgatactacttgcaacgactggcgtggcaccggactctaaggacaagtacggaggctcgcagcggttctgacgtgcaaatcgatcgtcaaatatgggcatgggggcgaaagactaatcgaaccttctagtagctcggtaatgatccctccgctggttcaccaacggagaccttgttacgacttttacttcctctaaatgaccgagtttggagcgcgtagcaggatattggccatttcctcaacaccacgtatcctagggggaaatgcacgtgtagatagctcaattacgtacgagacaatagcctcctcccacatccaggtgccggaatattgaccggcttccctttcgccacacggcgcaaagtgcgcctttgaaacggaacttccctacgaattacgggcttccggccaaaaaagtaggttattgagctagctttgaagagggctccttgcaacagctcttgcagctacacacacagatatgagctgatagtcataaatgctaggctatctcctcagatcatgtatatctcttgctcgggaccctaatttatataggaaatcatcgtgaaaaagcattttactcacgatatttacgctgggcaagtcggttctgcagtcttcggcgctgagctggatcgcttatttgggtctactcctcattagcgttgataaggcagctggaagcgcttgtattggtatagctgaaatattgtccttgggctggaggaggtaaggaggctgaaaagctgcatctccaagccctagaggccagaaagatatcccttggagagactcatccagatatattatttagcatatcaaacctcgcgtctcccgccttccacgcggatcggagggaagtgagaaggccagtatttcaaagagctcgcgaagctgattattctgaccaatcaggagaaggtcgagaaagcatctgagtccccagagtcgctttggaaactcgccaagtgggcgaggaacaaggaggctccagcacctacaaccacgccagccataaaggatccatcgacaggccacgaggcaactgagcccagtgccaaagcaatgctttgtatgggaaatcaaaaaaatcgactcacggccaccaaaccgcgcgaccgatatacatgacttttgtaaacccgccaccccatctcttctaagctaccctgaaggctatatcgcctaagatactggagaaggagatgtgcgggatgtaaagatagacaagagagtcataggtactcccgccgtttacccgcgcttggtcgaatggcttcgctttgacattcagagcactgggcagaaatcacattgcgtcatgcccgccaatttcccttataaacccggtgttgcaatccctctgaagcccgaagttgatcaccgatatcaacaccacctatgttgttattataatccgctgaaactgacgggatctgaaggaatttgaccggctttccgctaaattccctcttgatcgccggtgtaaacggtagtcatcatcaagaccaaggcgttatccttccaagcgatttggttgacctagagagcccgggacttaattagtaaggggattactagtaaaataagtagggatagctctcacaagaccatccggcgtagccacgcctcgcaacctgctcatggagaacagaaatctccagtagaacaaaagggtaaaagtccccttgattttgattttcagtgtgaatacaaaccagctcatggagaacagaaatctccagtagaacaaaagggtaaaagtccccttgattttgattttcagtgtgaatacaaacgatgaaagtgtggcctatcgatcctttagtccttcgacgtgtgaagctagaggtgccagaaaagttaccacagggataacccctctatggcgtcccgttccagggaactcggaaggcacgtcgccagaaacatcctctacaaattacaactcgggcttgcgccagcctctcgtactaagctcaattaccattgcggcgaggtcatcagtagggtaaaactaacctgtctcacgacggtctaaacacagctcacgttccctattagtgggtgaacaagatatgttgtcgctcgagacacatggtacaaggcccaactcagtggaagtgttaaaaccaatcaagaatataggaaggcgatgggagatatgttgtcgctcgagacacatggtacaaggcccaactcagtggaagtgttaaaaccaatcaagaatataggaagggtctgcctctacgatacgataaagcgagctaccagtggtgcctagactggaagcagatgggtgcacgctgtacattaatggcactcgtgagagcgcgccgaacacagcaccagcggcagggccaccgacgccgcgcacggcaatccaccttccccccctcagttccccagggcatccttccaccacaccaagaccactagggccggtgcggcttgggcgccccaagaggagtgctcatggcactcgtgagagcgcgccgaacacagcaccagcggcagggccaccgacgccgcgcacggcaatccaccttcccccgctcagttccccagggcatccttccaccacaccaagaccactagggccggtgcggcttgggcgccccaagaggagtgctcgcccgggaagcagctttagcgggttttagagtagtttttagtcggtagatctatgagagaaattagtataattttctgatctctctcacaaaaataagattcttttgcgctataactggcttgtggcggccaagcgttcatagcgacgtcgctttttgatccttcgatgtcggctcttcctatcataccggagcagaattgccatcggatttttgggatgggaatatgttcatcgcaaccagcaaatcggtttgccggctttgccacttctacttccagaacgaaggcagaaaccacaaccagctaccctatacccggcgaactcaaaccaaatctgccgccgccacgcagcctcgggcagggtgagaggataaaggcagaaaccacaaccagctaccctatacccggcgaactcaaaccaaatctgccgccgccacgcagcctcgggcagggggagaggataatgagaggatgcattggatcgagcaatgtcttttgcgtgatttggtacagcatgcggtctttattgggcgaggcagaaaccacaaccagctaccctatacccggcgaactcaaaccaaatctgccgccgccacgcagcctcgggcagggcgagaggataatgagaggatgcattggatcgagcaatgtcttttgcgtgatttggtacagcatgcggtctttattgggcgcggtgggaggaggcagagaagcttgggttgcaggtgatagaggctcgtaagatgaagcttggagcagaccatcccgatacactggcgagtatggccaatctcgcatcaacatatacgaatcaaggccggtggggcctgtggggcacgacaacgaccccgaggtggcaattaggttggctagaagaatggacggcatcctcgtggcgacgagcgcgtctgggaaggcggaccgtatcagcatcggaagtattagcaggcgattactctacggtactagaagtgtgctgtagtatttcgcgtattgtaattttaaaacgagcggggtcaaagcctttgcagacgacttagctgtgcgaaacggtcctgtaagcagtagagtagccttgttgttacgatctgctgagggtaatgcccttcactgggtgtagcggggaaacaggacttttactttgaaaaaattagagtgctccaggcaggcctttgctcgaatacattagtgttgagggtatagttctgcgcggaaactcgtcctagttccgtgaagctagatgtcttgtcaacatcgacgagcatcctaggaccctgtgcgtcggtgtctgaacttcgatgcagcagcggaatctgaatctccgtatcatagttacgggcaagcacgccctcgcgggctttggccgatccccaacaccacgccctaggggcatgagggttgaaatgacgctcagacaggcatgccccccagaatactggcgccagtgcccctcgtgggcgctggtggccaaccccggcgaacgatagttacctggttgattctgccagtagtcatatgctggtctcaaagattaagccatgcatgtctaagtataagcaattatacggcgaaactgcgaatggctcattatataagttattaattttaaaacgagcggggtcaaatcctttgcagacgacttagctgtgcgaaacggtcctgtaagcagtagagtagccttgaagactcctactttgaggatgctgctcgctccggcagaccacctgtagcctcgccagaagctgctaaagcgatcctttcgaaagtacgcactgatcgttacggccgtgagaagtcatgtgctgatattgctggttccgaagtcgggattttaagcatgtattagctctagaattaccacggttatccaagtagtaaggtactatcaaataaacgagtgctagagggacctaatatagtgcaaaatatagcgcaaaagaatcttatttttgtgagagagaccagaaaattatactcatttctctcataggtctaccgactaaaaactactctaaaacccgctaaagctgcttcccgggccacttttgattttccggctggttgagaagggcgcagatatcaacgcacagggcggcgtctacggcaacgctctccaggcagcatcacagggaggcgacgagacgatcgtgcagctgctggttgagaagggcgcagatatcattgcacgtcagaaccgctgcgagcctccaccagagtttcctctggcttcaccctatacaggcatagttcaccttctttcgtcgtaaagcttcgcaagagaccgacaactacgaaagcaagggcacgcccgatcaagagggaatttagcggaaagccggttaaattccttcagatcccgtcagtttcagcggattacaatgacaatatgggtggtgttgatatcggtgatcaacttcgggaaaatcgactcacggccaccaaaccgcgcgaccgatatacatgacttttgtaaacccgccatcccatctcttctaagctcccctgaaggctatatcgcctaagatactggagaaggagatgtgcgggatgtaaagatagactggctaccctgcagccgctcatcaagagatctctttccactccccttcttggtacccttggcagcagccttgacaacagacataccagcaccacgctcatttgcctcaaacttccatcggcttgagccgatagtccctctaagaagccagcgtactgccaaagcaatacgggctagttagcagggagctctcaatctgtcaatcctcattgtgtctggacctggtgagtttccccgtgttgagtcaaattaagccgcaggctccgagaaattagatagaattttctggtctctctcacaaaaataagattcttttgcgctatattttgcactatattaggtccttctagcactaatactcactgagttatagcggagttagcagttgagagctgtaagttatagcgaacttccctgctgcgttatagcggtctcagcttgagtattcgtagctcacccaaccttgcgcccggaagcccgatgagagtcgatacgcctcctcctctgcctcctggatcttcaccctcaacaagaggtacaccgcctccttgatggccatgagagccaccactcagctgactttgagacctactgtcaagagcagaagattattacagtctgtatacctccccactcctctcatcttcttcagccattagatattagctgctttggaccactaaagcagtcgtacggaagagaggttgagaagctaatacggatacatattacctatattagcaagcttgagtttctctcttcctttcgtacagctttcttccactcctttacagaggaaaatagaaagacaggtgaggagagtcacagttctctgcctcaagaggcagtgtacacagagagctgcatgaagtcggttgtgattatacttgacaacgccgaggtatagggtaactcgctctgcagcaagcctcaaaccttgcctctatagaggttaaaattgctgtggactgatgcacccaaagctagttacttgcctcaccgcacgctgaccgccttcctcaagtggctaatgttgatggttcgccggacgtcgagagcgcaccagacccagcagaggtgctgggctcttccggccattaaaccctagctccggacaaaccgattgcagggtgatagaccgttaagaagaaaagagaactctgcctggggcccccgccgtcgtctccgcgttcagttgcgttgcctgcattcgctgtggttggatttgtggtggtgtgggtgcgctgtggttgattatgtagtgggttgggtgcgctggggttgtaattttagcggggtgatacacgctatggctgacttccagttgcttatgtatactgttgtgggttgttttagtagggtagtattcaccgagtagggcgaaaaaaaaaaagggaaaaatgtcgtgacgtcatatatgcaggcccgccataacttaaggttctggggcagttcactatgacgtgccggttagcgtaggcatgtcccagcgtttatctacagtaaatttatcttgcagtcctctctcataggtgcaccgacccacatttaccctcgtgcacgccacggtcggttcccgggccacttttgattttccgcatgtgcctcatcagcctcttctccttcagactcaacagtatccccggcttcaacagagggctctcgcagccgctcttcaataacgctcgttatggataacgccagcattcactgttccgatgagatcaagcaattgtgtgataaggcaggtgtgaggttggaactgacggcgccgtatactcctgatacgaacccgatcgaagagttttttgctgagatgaaagcatgcatgaaatcacggtgggatgagcatattgaccttatccccactcagtgggaatctgcaagatacggtacagttgaagagatttcccacagcggatcggaccagcttgttacagttgactctcattgaagtatttgctactaccaccaagatctgcactagaggccgttcaacccgggctcacgccctaggcttcgtcatctcattgaagtatttgctactaccaccaagatctgcactagaggccgttcaacccgggctcacgccctaggcttcgtccctgacctccacgtccgcctactcctcagggcatcgtttctaccctgagggcgaggtatgggtgagacgcttgagcgccataaagctaaataccggccagagaccgatagcgcacaagtagagtgatcgaaagatgaaaagcactttgaaaagagggttaaaaagggcagcttgttataccacgccgtacgtgctgcaatgtatcgatggtatatagcacaaggatggtcataacgcatatctgactccgccgatggcggaaccgtggtaattctagagctaatacatgcttaaaatcccgacttcggaagggatgtatttattagattaaaaaccaattcgtgtctgcgtgtgctatgtagtacctttccattttctggtcgaaaattccaaaaagtgacaaaccacgcccaataaagaccgcatgcaacctacatatcggtaacgacaatagaggctatgaagattataaatggcttaatatcttgcaatttaatttatctatttggaacaagagatagatgagagaagggatcacaatatgagaaaaccactagagataaaccactagaggattgccggctccatgatatctggtcagataggtgagggtcaagtcgccaggcgagttgttgaaagaatgcatcgctaacgaaagaaaagggagcattggtgttgagcagaagtcccaggctcagttctcggatcaccttgactctggcacgcggcacgatgaccgagtttggagagctttccggccctgagtggtggtttccctcctctctgggccagtccggacgcctcactgagccaaccagctcgaaacacaggatacgatcctcagccaagaacatgtttttcttgaagatattcatgccatcaattcccttcttgcccagacgcctcgagagcgtgtgatcaccgtggaaatactgctctagaggtcgtcccataatagcacggaatcggtaagcagaaaaggcacctggcaagacagtaacataaccaaaggaccacaaatccaaccacagcgaatgcacgccactgtaaattccaccacagcgtgcatgcaccaccacaaatccaaccaccgcacatgcacatcgccgggaaccaaacttcagcacatgcacctcactgggaatgccaccaaagcatattcacacacaacgacacctaatatacgtcaaacgctctcgtagtccgcccctcccagcaaggcagacggcggccatgcagattcgcctcttgccctcggctcctaggcgattcaaagtccatgctgcttccaatggggatgacacccttcacctatacggactaattagcctctgaggttcgcgctctgcaaggatgctggcgtaatggtcatcaacgacccgtcttgaaacacggaccaaggagtcgtcttagtatgcgagtgttcgggtgtcaaacccctacgcgtaatgaaatccatccacagaacccatccagcgccggcgagagcagagctctccccagaccaggcatcctcagtacgacgtaccgcacccggccgcttccttgggctggaggaggcattttatgatgaggcttgataacttctgagcaggataccgaggtcttggggtggcaagtaatcgccagtcctacatcgtaacggccaccccgtagttagtcgactacaaatatggaggtttcatcagcaagcctggtagatctggcgtctgaacaggcgcggtatattactgggcagaagattgtggttgatggcggtatcacttcatcgactggctaatcgggcttgactctagtttgacattgtgaaaagacataggaggtgtagaataggtgggagcttcggcgccggtgaaataccactttatatattatccctaagtagtagtatttaaattctttaaatatatatataatagctataaattctttattatagatagggtaattaagttctatacagatgtttgctcatgggtctacgctaacggatattgcaccgggggagatacgagacaaagtgacacgagctaaaaccggcatgattggcttcttccgagatatccacacaagcgcattaggttcaccaacggagaccttgttacgacttttacttcctctaaatgaccgagtttggagagctttccggccctgagtgggggtttccctcctctctgggccagtccggacgcctcactgagccattcaatcggtagtagcgacgggcggtgtgtacaaatatttagctttagaagacgtatacctcccatttagagcagcattcccaaactactcgactcgtcgaaggagtttcacagcggctaggcatccaaccgtacggggctctcaccctctatggcgtcccgttccagggaactcggaaggcacgtcgccagaacgcctcgggagcagccagccactagccgggcaaccggccggcggcagccagcacctgggtgctgatgcccttagcaggcttcggccgtccggcgaacgtgagctgggtttagaccgtcgtgagacaggttagttttaccctactgatgacctcgccgcaatggtaattgagcttagtacgaacgtgagctgggtttagaccgtcgtgagacaggttagttttaccctactgatgacctcgccgcaatggtaattgagctgagtccctgcccgaggctgcgtggcggcggcagatttggtttgagttcgccgggtatagggtagctggttgtggtttctgcctccccggtaccccaacttcaaaccggtctcccgccttccacgcggatcggagggaagtgagaaggccagtatttcaaagagaccgtggcgtgcaagagggtaaatgtgggccggtgtatttctgaagagtacccaggctcatgggagggcgtcccgcgggcgaccgtggcgtgcaagagggtaaatgtgggccggtgtatttctgaagagtacccaggctcatgggagggcgtcccgcgggggctgcagggtatgtaaaatcaaaaaagttgttaagagccgcggtaaattattgttttagagggtgggaagcgctgtaagattaatcattacggcggtcctagaaaccaacaaaatagaaccacacgtcctattttattattccatgctaatgtattcgcgcaaaggcctgcctgccactgtaaattccaccacagcgtgcatgcaccaccacaaatccaaccacagcacatgcacatcgccgggaaccaaactccagcacatgcacctcactgggaatgccaccaaagcatattcacacacaacacacgccacctaacctatactttacataaccactgtaaattccaccacagcgtgcatgcaccaccacaaatccaaccacagcacatgcacatcgccgggaaccaaactgcagcacatgcacctcactgggaatgccaccaaagcatattcacacacaacacacgccacctaacctatactttacataatatcagattcctctccagcctccctgcaggttcggatattataaccaggctttccgcagttgctatatcgtggagtctttgtacgagcctgccctccctggctactacttctgcggtcttcccctcttagctgcttatctatatccttctggtctaatagatctattccatcctgtatagttagggatcctcattctgcttcggtatgataggaagagccgacatcgaaggatcaaaaagcgacgtcgctatgaacgcttggccgccacaagccagtaaaacaataatttaccgcggctcttaacaacttttttgattttacataccctgcagcgcccgcgggacgccctcccattagcctgggtactcttcagaaatacaccggcccacatttaccctcttgcacgccacggtcggtgatggagagtgcgcttgaaggacgtatcggccctttctcttctcaggtcggggggaaccactggcgcaagaaatcccggtgcgggcgctgtggcagcaaaagcccactgaataggctcacatatagaaaggcgaagtgacggcgatgccgttcttctgggggattgttttggattcgggtatatgctaaattgaaccctgtgaatgaatgagtttgttggtgtcgccaccaacagttatgagcccggttagcacgctctttacatccttacttaactactccttcgttatagccttataaggggcaaataaatacctcaaggtaaaggagcatccaaatttattgttggcattaacactgtaaaaatatttgtcatttttttttctttttaatatagcgtactttctttaggggaatttataaggatggttggtttgattgttgttttttatttgcgtctcacccatacctcgccctcagggtagaaacgatgccctgaggagtaggcggacgtggaggtcagtgacgaagcctaggaagagacgattttgcgatacgaagataaaatcatcgcgatgtattcgtccggctcgaccccgattcaaatagcccgctttgtcgctagcgaggtcagtaaggtataagaagccggtgaggttattaccagcgtcattacaaaggatatctcgaatattatagcccagcatcgcaaaagccggctacaaggccggacccctatccagtatctgtatcagcatttgaacaaggaagggtcctagtaccagcccgttacctctgactccctccataataccggcttcatccatattccaacggtctctcggagagatgtatttgatagccggatagttcattattacgaagaaatccttgacccggtcagccgtagccccattgatacgaagaagatcaattcgcttgcctcgtaacatcttaatggcgtccttattgctcttcgaagaatgattccccgcatcatttccgatcgcgcgtctgcaaatttcatcatacaaccctatcattaatgccacgacggttcctagtaggatccgttgaaatttggtgggtgaattttcacgctactaaaaggggacgtgggttagtcgatcctaagccatagggaagttccgtttcaaaggcgcactttgcgccgtgtggcgaaagggaaggcggtcaatattccggcacctggatgtgggttttgcgcggcaacgcaactgaacgcggagacgacggcgggggccccaggcacgcggtgaggcggaccggccagccaggcccaaggttcaactacgagctttttaaccacaacaactttaatatacgctctgcagacaaatcactccaccaactaagaacggccatgcaccaccacccacaaaatcaagaaagagctctcaatctgtcaagccaatatctcttggcgagtgagtcgacggcggagctcgaggtagtcatgaacaacgacacgagatggaattccacttaccttatgatctctcgagcgctcgtgaagcagggagacattagggcgttcttggtccatccagaggtggagaagtggctacccgatgaagagcttcacgatcgtggcgagtggaaggtcgggattgtcccaatccgctacgtgtgttcggttcaggggccagttgtcctcatctttcgtactcgtcatgacccaagctgacgttatcaacgacgggactttgcttgaacaagggtatcctttttcgtggctactgttccgacaagtcgtgggaaagcgacgcctgtgtcaaggtctgcatggacgaggcggtacgtatcgaatattcacacttttatatccgaggcatcaactcacaattgacactgttatataatatatacataatagaataaactactttttataaacatatactaaaaaataaataactttaagatatataattgttatttatataaatagaggagtggttataccccagatcatgtatgcatgctccgcgtggtccaacgccaactggagaacacaaaacatgccatatactactaaaacgctggagggactgcaacgcctgcaagcacgagcggccagagtgataactggtgctttcaaagccacatcagctccagtatcttaggcgatatagccttcagggtagcttagaagagatgggatggcgggtttacaaaagtcatgtatatcggtcttctttgtggaagacccttaccgtacagtcgatatgcctggccgtcttgaaggaagagtagccctcgtttccggcactaccccgcaaaattcattactatgggaaatctaaaaaatcaactcacaaccaccaaaccgttcgaccgatatatatagcttttataagacccacttttatctgaaagaggctcttaagctgatcagttaagtatagatattagaggaaaatatccaggcaggctttattggatctggcctaatgccgtacgacccaaagagggttctttcaaagctagatgtggcactgcgaacaccaacaccaccagagaccctgcctgagatcagccttgcgaccatactccccctggagcccaagcactttgatttctcgtaaggtgccgaacgagtcaatttttaacatcaatcctaagattccaattaaaaaaagtactaaagttaaactcatttttttttatttttattatctcaaattattcagattacgatatatgtataatactaatttattaaagtgtggtggatcggtctcgagtttgttgggcggaaagtaagttaacagtccagcctaaagagcgcagttactaggtgataatgaccttgaaactcaaccgctgcgcctagcacacgcaggtttggcggcgaggaatgtgttgaaccggtgaggaatgtaagtcatacaaccgatgaatttatgatcaaatgcttccagaatgatatattccttcttttcttaccttcgcattcatcgcacgtattacagccaccaccacaaatccaaccacagcgaatgcacgccactgtaaattccaccacagcgtgcatgcaccaccacaaatccaacccaattaaaataacaacagctaattatctataataataatactagaaattgatttatcagattcctctccagcctccctgcaggttcggatataccgaatgtactagccctgaaaatggatggcgctcaagcgtctcacccatacctcgccctcagggtagaaacgatgcccggaggagtaggcggacgtggaggtcagtgacgaagcctagggcgtgagcccgggttgaacggcctctagtgcagatcttgcttcagcacatgcacctcactgggaatgccaccaaagcatattcacacacaacacacgccacctaacctatactttacatacttcagcacatgcacctcactgggaatgccaccaaagcatattcacacacaacacacgccacctaacctatactttacacaggagggccggtctactgagcgtgagctacaggcggtgagatagcctgtggggtgcaggttatgtgaggtgcaggttatggaaagtgtaggtcatgtgaggtgcaggttatgtaaagtgtaggttatgttgagtataggttatgtaaagtgtaggttatgtgagcgacgttgaattcgatgctctgtggtatattccggtgcctctatgtttccgggtatatattaatatagatggcgcccgtcgacgacaactgctggcatcgtcctctacgtgtaggggttcatgcgtgtgatagattccgcaaagtgtgaatattgatacattcgaatgctcacgttcaattaagcaacaagagcttcttacatatttaaagtttgagaatggatgaaggcaataatacttatatattaatagtaatttatattatatagcttataataatctaattatactatttagaataatactctaattaatttaattttaatttattctaaattctatctagtataagttattctaactattatatattaataactcttatttagctaattattttattttaattattatataataataaaaagaagatattataattaccttaggaactttagcttagtagaataatatcttaagagtacttactatttaatagatttttaaataacttatactttaaattaagaactttaaaaagaataaactatagaagaattagaataagattatttaattaatactattagaatcttttattaagaatattcaaaaacttaataaatttaagatctagttttaaatatattttaagttttttttaataaaacttaaagaaaataaaaataaaattagatttatagaaatatatcttattagtactataaaatactagttttaaatatatctttatgattaatataataataaaatcgggcccggcactagacgtcgagacacacctcctgccgataaaacaccagatatggaagcacaatctcgaggcactcataagactcggtccggccaaatctaaaccaatgaaagcaaggcaaaaattcagcccacgtgatgcccccgtctaaaacccaatctagtaggggagttggcagcgcaatctcaacatgccgtagtgaaggtgttcccagcacaaaccggtccgtggcgttcagaatcttgcccagatctttgcgacggcagaatagatattgatctgtaagagaaggtatacgtattggagctggggaaactgagcggcaagggaatcatttcaaccctcatgcccctagggcgtggtgttggggatcggccaaagcccgcgagggacggccggcccctaaatctagtatttcaaccctcatgcccctagggcgtggtgttggggatcggccaaagcccgcgagggacggccggcccctaaatctaggggcggacccgtcgtggcctcctctgcgaagtagtgatattccgcatcggagagcgacgagcccctgccgttaaaccccctgtaatccatctcccaaaccccctacgcagccagccaccagggccgcctgtattggggaaatcgaggcgaaggacggcttgtcgaagtgtacgtagctaaaagcactgggccctatgaggtaaatcctcccgggcgtaataaacttcattcattcattctagactgaaaacatcattggctctttcgtgatgtacacattcaccatcatgatgaccagtttcctcatattctccttgtgtcccagattcactcccacagtctagtccagtctttctgtccagtgctagctcaacctcagggactacctcgaccccagggactacctcagcctcccggccctccctgtatctagccactgtcctcgacttacagcgcttcccaccctctaaaacaataatttaccgcggctctcaaagtagaacaaaagggtaaaagtccccttgattttgattttcagtgtgaatacaaaccatgaaagtgtggcctatcgatcgtttagtccttcgacgtgtggtggtgcgaaggaatacgagcgcctacttcaacagaactacaccacagactctaacttctctggtgatgccattcctcaagatattcaagaacagattcaaaatgcagaaagagaagatctagagctttaaaataatatatcttatgactatacccggcgaactcaaaccaaatctgccgccgccacgcagcctcgggcagggtgagaggataatgagaggatgcatggcgccacctaacctatactttacataacctatactcaacataacctacactttacataacctatactcaacataacctacacttttttatcggcacagcctgcttgcgtttgcgtgatgtgagaggcttttcaacttgcgcaggctcttgtgttattacgcgaaattcaacgaataatacaactctcttctcctcgaataaccagctgtaggcggtccggcgatgtgcatgtgctgtggttggatttgtggtggtgcatgcacgctgtggtggaatttacagtggcgtgcattcgcccggcgatgtgcatgtgctgtggttggatttgtggtggtgcatgcacgctgtggtggaatttacagtggcgtgcattcggtgtggttggatttgtggtggtgtgggtgcgctgtggttgattatgtagtgggttgggtgcgctggggttggaattttagccggcgatgtgcatgtgctgtggttggatttgtggtggtgcatgcacgctgtggtggaatttacagtggcgtgcattcgttgtggttggatttgtggtggtgtgggtgcgctgtggttgattatgtagtgggttgggtgcgctggggttggaattttagtaacataattatgcccaaggtgggattcgaactcacgacctaaacaacttcaacgttccgctcaacctctgagcttctcgagctttatatatatgacagttatcaatacaatcgctaccgccttcattgaaactagctcctcagtgctcgcacattagcagtgactcgcacagcaccaagacaacctgaaagagcatacggggccggacccgaaagaaggtgaactatgcctgtatagggtgaagccagaggaaactctggtggaggcgcgcagcggttctgacgtgcaaatcgatcgtcaaatatgggcatgggggcgaaagactaatcgaaccttctagtagctggatccgagaacatcaggatcggtcggagatgcgccgaagctctctcctacgttcactttcattacgcgtaggggtttgacaggataaccgtggtaattctagagctaatacatgcttaaaatcccgacttcggaagggatgtatttattagattaaaaacaaatgcccttcggggctctctggtgattcatgataacttctcgaatcgcatggccttgcgccggcgatggttcattcaaaagggcttgagccggcgttgctctatgactttgcatattatgtatgctagatggcagtatacccctggttgctatcgcagtgtaggtcggcggcatcgctacctgcccattctgccccgcgctcctcagctcccgaaccataccgaccgcggtcttgcttcaaagacatcgcagacgaagcgggcatttctatggaggagttcaagcgaacatttgaaaaagggaacatcttcacatccggcatttctgtcaagtactcagagccggaaagctctccaaactcggtcatttagaggaagtaaaagtcgtaacaaggtctccgttggtgaaccagcggagggttgtataccaggtaggtggcgccttgggggttatccttgtaggtatctctttaaggcaaaggaggaaagaagagtatataggtataagcacctggcactggctttataggcgattatgatactctttggtaggtgactacaggggctgctggcctctgcataaggagtaggcggacgtggaggtcagtgacgaagcctagggcgtgagcccgggttgaacggcctctagtgcagatcttgggggtagtagcaaatacttcaatgagaacttgaaggaccgaagtggggaaaggttccatgtgaacagcggttggacgtggggtttaacaagattacccaggcctttcggccaagggagtactcgctggctccgtcagtgtagcgcgcgtgcggcccagaacaccccagggcatccttccaccacaccaagaccactagggccggtgcggcttgggcgccccaagaggagtgctcagcgcaccgcttcaaccatggcggtgtccgctcaatcttcgcaagggtggcttgggctgctgcccacaaaggggtctcggtgccgtgatcagagcgggtgaaaaaaggccgcatccgtaggtgcctcacggtctcaagaaactgcttcaatgtgctcatcgaggttgttgctgatcggccaatatagaacccggtgaaataccactactcctattgtttttttacttattcaatgaagcggggctggatttacgtccaacttctggttttaagagatacgaggtccgctaatgcgagcgctatagtggacacgaggtccgctaatgcagctgctacagtggttacgaggttcactaactaagtgctaaggttctcgtacagcggagacctatatccacgaaagtcaatggaaagctccttgccaggtcgcggctcgggacagtgtgatgatggatcgggcaagctatcgggatcattgggaactgatggcatgggaaaggaccaccgacgctatctgagactctcaatcatcaccgtatggcagaaactcaacgagtactacaccaagcttggagagtcgccgttgttcgccgcatccatcatcctccatccgtcgaagcccctatcgtggtggaagcgggttatcttctcagatgagaccacagttgcgcgtggtcagggagagagacagaagtgggtgttctgcctcctagtgatatatataaagctcgagaagctcagaggttgagcggaacgttgaagttgtttaggtcgtgagttcgaatcacaccttgggcataattatgttattctatatcatttcttataaaaatataattatataaaaacttttgtgctataaatcacttcgtatgcgagagttcgggtgtcaaacccctacgcgtaatgaaagtgaacgtaggagagagcttcggcgcatctccgaccgatcctgatgttgtgagtggagagacccacaatatgaatcaaaaagaagtgaaaatatgatcgtttaggctctgcgataataacaaaaattgcttaagtttttatttatttgtaaaaactactcagaagattccaaaataaaacaagaattaagtttcctaggcgggcgcctgatccgggggccaccaaagcatattcacacacaacacacgccacctaacctatactttacataacctatactcaacataacctacactctacataacctatactcaacataacctacactttacataacctgcacctcacatgacctacactttacataacctgcaccttcgatcacaagatgtagtcacccgtggaacgccacgtctcgataggccgttctctagaccgaccaccgctgatctagagagaccccctgtcagaaatttctaacggaaagccaatagagtggtttgtaaccaatgtgttggagacatcacgatgactggatacggggacttccctatggcttaggatcgactaacccacgtccaaccgctgttcacatggaacctttccccacttcggtccttcaagtctgctgacctctgccgtgctctgcgagagagaggtcacggaacaacaggcacatgccgccgcaactgtggcatttttgagccttttatccgggctaaggttcgcatggccttgcgccggcgatggttcattcaaatttcttccctatcaactttcgatgtttgggtattggccaaacatggctattttgccgacttcccttatctacattgttctatcaaccagaggctgttcaccttggagacctgctgcggttatgaggacgacctggcgtgagaattattccttcccgcggattttcaagggacgtcgagagcgcaccagacccagcagaggtgctggcacagctaagtcgtctgcaaaggatttgaccccgctcgttttaaaattacaatacgcgaaatactacagcacacttctcgtaccgtagagtaatcgcctgctaagacgctaagccgaagcctattcttgtccatctgtacgtgcgggtggtatcaccgatttctgaagagtacccaggctcatgggagggcgtcccgcgggcgctgcagggtatgtaaaatcaaaaaagttgttaagagcgttagcgatcataaccgctagctgttagcgatcataaccgctagctgttagcgatcataaccgctagctgttagcgatcataaccgctagctgcggaaaatcaaaactggcccgggaactgaccgtggcgtgcaagagggtaaatgtgggccggtgtatttctgaagagtacacaggctcatgggagggcgtcccgcgggcgctgcagggtatgtaaaatcaaaaaagttgttaagagccgcggtaaattataccgtcgtgagacaggttagttttaccctactgatgacctcgccgcaatggtaattgagcttagtacgagaggaaccgctaccgtcgtgagacaggttagttttaccctactgatgacctcgccgcaatggtaattgagcttagtacgagaggaaccgcgcattcagataattggtttttgcggctgtccgaccgggcagtgccgcgaagctaccatctgctggataatggctgaacgcttagatttataactatagtttatatatattaataatagttagattaattcttatactaaactattatatataatttatactattagtaataggagcagggcgagggcaaggacgacgaagaggcacaagggagagggggtgagaatggcacagaggcatatgagggcgaggttgaagacgacacagaggcatgcgagagcgagagcgtaagcgaggatgagggggttgaggctgaggagagcgagtatgggaacggtgatgagagtgaggatgggatttaaattgtactcattccaattacaagatccaaaagaaccctgtatcagtatttattgtcactacctccccgagtcgataatatatctcttaaagctatattttataataaattaaaaaaaaaagtttaaaaactaattttttaaacttaataagctagaagaattattagaatatatagttattataatatatattaataattatctttttaaataaaaataataaaaagaagaaaaataaagtaattagaattatattaaaataaactataaatctaattaaaaagtataataagctctattactatttataatatctagaatatatataaattctatagagttaaaagctataaaaaaatataaatactataactataataagattaaatatatattactttaatatttaaaatctaaaaaatagaaaaattagaaatctactaaagaattaaaaactattagaaaaactaaaattaaaactcttagaatagttagaaaaactacttagaaagaaactctaaataatattaaaattcctaaattttctaaaatatatatattatttctttataaaatactagagaattctaaaaattaaaattataatataataataaaaaattaataataaattaagaagatattttagaattttaaaataaaatataaaataaactaagaattagaatataatttatttataatatataaaataatatttagatataataataagtttattaaatattggccgaaaggcctgggtaatcttgttaaactccgtcgtgctggggatagagcattgcaattattgctcttcaacgagcagccgaagcctattcttgtccatctgtacgtgcgggtggtatcaccgctttctggcatggattctgacttagaggcgttcagccatgggcatgggggcgaaagactaatcgaaccttctagtagctggtttccgccgaagtttccctcaggatagcagtattgattccccagagcttcgcagccttacgcaagcctaggccctccttattagccaaaatcgcccgttgaagtgcgtcctctgtatagttttgcattgcgattctaatgatataaatatcaattaaattggataagaaatggtgaagttatcgcgtaaattaaattgttacgaatctacgctgacaaggggcagaggtcacgtgggacccatttcttttcttccctaccaccagtaacataagggacgactggatcattgggatctggctatgatcctcatgatccaacccacggatcattgaccaaacctcatgatcgatggattgaggaaggccgctcctttgttcttgaagaggacggcgatagcggccacgggccgggcaaatctaaccccgtgagagcctggaaggaagagtatagtcttaagagctatttcaactgccctcgaagcccggatctctctccaattgagaactgctggcttgtgccaaagcaatacgtacctaggccaaagaggctatttcctccgctggctgtggtatataccagattcagcttacggccctgttggtgttgcggctccacaggctgcaagagatcgcaagaggaagcggcccggatactggagaaggagatgtgcgggatgtaaagatagactggctaccctgcagccgcttcccgagagacagaccgggcgccatactggagaaggagatgtgcgggatgtaaagatagactggctaccctgcagccgcttcccgagagacagaccgggcgcaagaactctggcgtccttgtaatccatctcccaaaccccctacgcagccagccaccagggccgcctgtattggggaaatcggtgtattgatagctgtagctgaatcggatggagctaatgttgtgctatcggttgatatagtgctgctcgtgtcgttactgtctgatgccttcctcactaaagcccagggtaaaatcattgaatggaaggatatatgaatggtcgtccatggttgctgcagacacgagtaatgggaagttaccgaatctaagagaggccacagcccaaacacgagcctctaaggaagagtcacctcttcaaagtccgcttggcctacggttacggatcaagcctctttgttcggagggaagctcccacctattctacacctcctatgtcttttcacaatgtcaaactagagtcaagctcaacagggtcttctttccccgctgagctcccacctattctacacctcctatgtcttttcacaatgtcaaactagagtcaagctcaacagggtcttctttcccccctgaagctcccacctattctacacctcctatgtcttttcacaatgtcaaactagagtcaagctcaacagggtcttctttcccctctgattctgccgaatccctagtaagcgcaagtcatcagcttgcgttgattacgtccctgccctttgtacacaccgcccgtcgctactaccgaggtgttagtacatccagacagttggacggtggccatggaagtcggaatccgctaaggactgtgtaacaactcaccaaccggccaccgtcctccaggcccgtgctggttgcgtaagtttactcctagctcaaaccgtattcataaattacgctaaaacatcactacatccaaggaaggcagcaggcgcgcaaattacccaatcccgactcggggaggtagtgacaataaatactgatacaggaaaatctgggctgtagctgaagctggctatttcctctcgtggctgccgcacctgcctcgtaaggtatttgactctgttggcgataacaagcctcgaacaaggaagaggaagagagatgatgaagttaggggtatatggctcagtgcagagcgggtcaggaagggggcaggggaggtagagcatttccggcggcagctagcagagctcgttgaagagcaataattgcaatgctctatccccagcacgacggagtttaacaagattacccaggcctttcggccaatggagtactcgctggccgaaatttttaggagcagagattcgtaggtatgtgttacccgtaccggggttaggcatctctatctacctgggatgactacacgacacatatctaacctacatatcggtaacgacaatagaggctatgaagattataaatggcttaatatcttgcaatttaatttatctatttctgcgactggaattcgggactagacatggtccaattgaaacctagggcaaatcttcgctaagtcccacttagaatcctaaaggtattccaaagtctctttctcggctagcactttagactattaatacgcattgtgattaattgtgctcatctcgtttaatttaaaattatacttatttagaaataagaaaagttagttatataagattattagttaatttatctctataagtatagtatacgacttttacttcctctaaatgaccgagtttggagagctttccggccctgagtggtggtttccctcctctctgggccaggccggacgcctcactgagccattcaatcggtagtagcgacgggcggtgtgtacaaagggcagggacgtaatcaacgcaagggggatgactggaggctcttggcagaaatcaagcatatccttgagccgttccatctgcagaccatgagaacgcaggggtagggtagcgagggaggtaatagacgactttgggaggtgatgacaggcatggaatacttgctggaacacctggaagatcggaagctgttctatcaggctgcgccagcgaagccgaagccgtctagcctgtccaagtgaccactcagtgggaatctgcaagatacggtacagttgaagagatttctagctggtttccgccgaagtttccctcaggatagcagtattgaactcagttttatgaggtaaagcgaatgattagggacgcgggggctatatattgccttcatccattctcaaactttaaatatgtaagaagctcttgttgcttaattgaacgtgagcagtctgggtgtgctatgtagtacctttccattttctggtcgaaaattccaaaaagtgacaaaccacgcccaataaagaccacacaggctaccctataaccagcctaccctagactaggtcttagatcttgaataattccttcagctttaaagataagatatttaatatctatactcatgcttaccaaaaatggcccactagtattgatacattcgaatgctcacgttcaattaagcaacaagagcttcttacatatttagccccgtacggttggatgcctagcctctgtgaaactccttcgacgagtcgagtagtttgggaatgctgctctaaatgggaggggccagatgtatgcaccgcctttgggccacctctcccccaggggaaaaggctcgggaaggtgcgggggaagaagtcttcgtgcaggctgtctgcaaagtccgcgcctcgttctgtcgaaaattccaaaaagtgacaaaccacgcccaataaagaccgcatgctgtaccaaatcacgcaaaagacattgctcgctccttcaatttacgcgataacttcaccaattcttatctaattcaattgatttatatatcattagaatcgcaatgcaaaactatacagaagacgcacttcaacgggcgattttggccaataaagagggtctaggcttacgaaaggctgcgaagctctggggaatcccattgactaccttgtaccagtagaacaaaagggtaaaagtccccttgattttgattttcagtgtgaatacaaaccatgaaagtgtggcctatcgatgcaggcctttgctcgaatacattagcatggaataataaaataggacgtgtggttctattttgttggtttctaggaccgcagtaatgattaatagggacagtcgggggcatcagtattcaattgtcagaggtgaaattcttggatttattgaagactaactacatcaatgagaacttgaaggaccgaagtggggaaaggttccatgtgaacagcggttggacgtgggttagtcgatcctaagcaagttatagcgaacttccctgctgcgttatagcggtctcaaggcctaatacaccttgaaggccactgtaatttcaacaaagagaactagtaaaaaaaagatataatttaataagactagctctatagctaaacttcttaaaagactaaagtaattaattaatcctataatataatatcttatagataaatttaacccagtctcttcgtcggctttaaggtccacgcattgatcgggatagtggtctgggcctctgcaataccagcacgccctatcattaatgccacgacggttcctagtaggatccgttgaaatttggtgggtgaattttcacgctactaggttgttttagtagggtaggtgccctgtaactggccgggtgcttgcatgatcatggtgagagtgtctgggtgtgctatggagtacctttccattttctggtcgaaaattccaaaaagtgacaaaccacgcccaataaagaccgcatgctgtaccaaatcacacggaccaaggagtcgtcttcgtatgcgagtgttcgggtgtcaaacccctacgcgtaatgaaagtgaacgtaggagagacacggaccaaggagtcgtcttcgtatgcgagtgttcgggtgtcaaacccctacgcgtaatgaaagtgaacgtaggagacatcaggtagttgctaggtcaacattacccagttctagcactcggcgcgagccatctgcatttgaggctatcgagcaagtatcacagatgcggatagcagctaagcctacatgctcaaggtatcatactcagggccacacaatgagctcaaaggcatgccctttgcgatatacgcatcttaggccttctcccaccccaacagcgcttccaaacacgctactgccatccgttacgccagcttcagctccactattctatttaactattactttatagatagtaagctattaaaaacttatattttatatctatttatactataagtaattactaaaacttaaaggtaaatattactcctctatttaatattattttattaggtaatctatagtaactaactatatattatagaaactagtatatgaatacatcgcgatgattttatcttcgtatcgcaaaatcgtctcttttcggaacttcgggaaagcgacctttggagcgaagggatgagaggagcagacaagttaggtggaccctatataaaattcatctgggcgtgcaagcttcactcccctttagaaggcagcgcgaccagtgcgacacccctgcatttgcgagttggccccagccagcatgaaacagtttgttgcgcctgttgagtttgttggttgattgatgaaaatagacttctgggcgagtttgtaccccacacagagccgtcgaccacctccaaactgccaactaccggcagccaagtctgtctcgttcccatcgagccatctctcgggcttgaaccgcaaaattcatttgtatgggaaatcaaaaaaatcgactcacggccaccaaaccgcgcgaccgatatacatgacttttgtccgcaaaattcatttgtatgggaaatcaaaaaaatcgactcacggccaccaaaccgcgcgaccgatatacatgacttttctgttatccaagtagtaaggtactatcaaataaacgataacttatataatgagccattcgcagtttcgccgtataattgcttgttatccaagtagtaaggtactatcaaataaacgataacttatataatgagccattcgcagtttcgccgtataattgctgacactagtagcaagtctgttctcacaggtggctaaggtccagagtagagaagggctccatcagctgcgtatgaagttagtcatggcaattgctagcctttgcaagaggcgcgagagtccttgccgccgcccagctgttgccgcttcactcgccgttactagggcaatccctgttggtttcttttcctccgcttattgatatgcttaagttccgcgggtattcctaccgcgggccgacccgggttgaagacattgtcaggtggggagtttggctggggcggcacatctgttaaaccataacgcaggtgcagctagtggtcaggatcgctaacagcgatctgaccccactaacttatagtggctataatctctcaaattcaacagataagatattcaatatctatactcaactgatcagctaaagagcctctttcagataaaagtgggtcttataaaagctatatatatcggtcgaaggttttggtggttgtgagtcgatttaagacgctaagccgaagcctattcttgtccatctgtacgtgcgggtggtatcaccgctttctggcatggattctgacttaggttcaccttggagacctgctgcggttatgagtacgacctggcgtgagaattattccttcccgcggattttcaagggacgtcgagccgccgcagaacaactcagcgaatcattcgctcgagccattgcacaacggtgggaaggcctcgtattgaaaggttgcgatgacccatacttctcgttcgacacaagcaaatcgttcatcaagctaaaaaaggattatattccaggccttggagacactgcttccctatggcttaggatcgactaacccacgtccaaccgctgttcacatggaacctttccccacttcggtccttcaagtcttccctatggcttaggatcgactaacccacgtccaaccgctgttcacatggaacctttccccacttcggtccttcaaggtctccccccggggcgaactgatgctggcctgggcaggcagagtgcaccgcggagaaccacggatgatcaacctgcccaagtctggagcaagtcaaggctgccgctggcggcgccgagaagaaggtcgtgaaggcagccattggcgcttccaaagtgaagaacagcatcaagaagaagccagtacgacgtaccgcacgcggccgctttcgtgagggtcgacgcccactatgaatcacccgccagcgaagccgaagccggctagcctgtccaagtgaccactcagtgggaatctgcaagatacggtacagttgaagagatttcccacagcggatcggaccggtcgcgcggtttggtggccgtgagtcgatttttttgatttcccatacaaatgaattttgcggaaaatcaaaagtggcgcgggaaccgaccgtggcgtgcacgagggtaaatgtgggtcggtgcacctatgagagaggggcgcgagtgctgaaggcgacccactaatagggaacgtgagctgggtttagaccgtcgtgagacaggttagttttaccctactgatgacctcgccgcaagggtaattgagcttagtacgagaggaaccgctcattcagataattggtttttgcggctgtccgaatccaaccacagcgaatgcacgccactgtaaattccaccacagcgtgcatgcaccaccacaaatccaaccacagcacataatccaaccacagcgaatgcacgccactgtaaattccaccacagcgtgcatgcaccaccacaaatccaaccacagcacacgcacatcgccgggaatccaaccacagcgaatgcacgccactgtaaattccaccacagcgtgcatgcaccaccacaaatccaaccacagcacaggcacatcgccgggaaccaaacttcagcacatgcacctcactgggaatgccaccaaagcatattcacacacaacacacgcacccgcgcttggtcgaatggcttcgctttgacattcagagcactgggcagaaatcacattgcgtcaacaccactttctggacccgcgcttggtcgaatggcttcgctttgacattcagagcactgggcagaaatcacattgcgtcaacaccactttctgtccatcgcaatgctatgttttaattagacagtcagattccccttgtccgtaccagttctaagttggttgttaaccgtacgtacatccaaggaaggcagcaggcgcgcaaattacccaatcccgactcggggaggtagtgacaataaatactgatacaggatttaaagtttgagaatggatgaaggcaatatatagcccccgggtccctaatcattcgctttacctcataaaactgagttcaatagctaaccggcacgtcatagtgaactgccccagaaaccttaagttatggcgggcctgcatatatgacgtcacgacatttttccctttttttttttcgccctactcggtgaataaagcttgcggcgtgaggacaagaggtgagtttgccttgtcttatgccttggcgactgggatctgggaagcggagatgaatcagggaggggttggcttctccgacctccgattcggaagttgccattggtctgcctctattcaccgagtagggcgaaggaattatttatttaatctctctctctctctcttataagtagtaagtttattcctattcttatttatatagttcctttagttattttaaataaaagataatagttataatagttaaattaaatttactatatctaatatctcctccctctctaaacataacctacactttacataacctgcacctcacatgacctacactttacataacctgcacctcacataacctgcaccccaccataacctacactttacataacctgcacctcacatgacctacactttacataacctgcacctcacataacctgcaccccccaggctatctcaccgcctgtagctcacgctcagtagaccggccctccctgtatctagccactgtcctcgacttacagcgttatatattaggttatagtaggcctgtataagtaggtagctattcttaagatatagcttttcttctagctagtctctatcctctataagtatctacagtagtactaggcaggctatataataaagtaatagactaagtagatatagctactggatctataatattaaaagcagctttattactataagcagctgtctccaaagtctcgcttcttcctcttcaacctctatctacatccacttaccagcttttgtggatagtggttcttatattaatgtgtatgcgttcttaggctcctacgaggcggtttcctcatttgtgcgtccaatatacctccagtctccccccagtgtagggctcagggattgccctagtaacggcgagtgaagcggcaacagctcaaatttgaaatctggcgcaagcccgagttgtaatttgtagcagggattgccctagtaacggcgagtgaagcggcaacagctcaaatttgaaatctggcgcaagcccgagttgtaatttggagaggatgtttctggcgacgtgccttccgagttccctggaacgggacgccatagagggtgagagccccgtacggttggacgcaggcgtcgctttcccacgacttgtcggaacagtagccacgaaaaaggatacccttgttcaagcaaagtcccgtcgttgttcacaaacatcctctccacatctcgtcttactaataatagttacctcggccctcttacttggagatctggagcctaatgtaagtcccacatttcgattctaactatacacttagaaggttgctggtggttagccagcagttcagatttcaagccacccaacccactacataatcaaccacagcgcacccacaccaccacaaatccaaccacagcgaatgcacgccactgtaacttccaccacagcgtgcatgcaccaccacaaatccaaccacagcacatgcacatcgccgggaaccaaacttcagcacatggacggggctgagcgaggataacctgctcaccatccgtcgcaaccatccactcgtcaaccggtataacaaagcgatggcgatcggtctccgccacaaccacgatatatcgatgatcttgacgaggaccaagggcctggccatggtgttttacatcaccaaagcctacattttgataattagtccattttcattgcaggaagtgctagcaatttcattctagcgagaaatcgctatgatgcaatggtgtggagtcaagcacggcgctattgaggtatgattctgtcctgttgacggaagaggagagtagaaaactttgagaggaaaaggcgagagacgaagcggaaaggcaaggggggctgcgagttgagaatgggcttttggtgccgaattagaagcattggtttttaatctaataaatacatcccttccgaagtcgggattttaagcatgtattagctctagaattaccacgggtatccaagtagtaaggtactatcaaataaacgataacttatataatgagccattcgcagtttcgccgtataattgcttatatgtgaggtgcaggttatgtaaagtgtaggtcatgtgaggtgcaggttatgtaaagtgtaggttatgttgagtatagggtatgtaaagtgtaggttatgttgagtataggttatgtaaagtataggttaggtggcgtgtgttgtgtgtgaatatgcttcgctatggctgacttccagttgcttatgtatactgttgtgggttgttttagtagggtaggtgccctgtaactggccgggggcttgcatgatcatggtgagagtgtctgggtgtgctatgtagtacctttccattttctggtcgaaaattccaaaaagtggccacgtgcagcggacaccgccatggttgaagctgtgcgctgagcactcctcttggggcgcccaagccgcaccggccctcgtggtcttggtgtggtggaaggatgccctggggaactgagagggggaaggtggattgccgtgcgcggcgtcggtggcccagtgggaatctgcaagatacggtacagttgaagagatttcccacagcggatcggaccagcttgttacagttgacccgagacgctgtgagtgggaatctgcaagatacggtacagttgaagagatttcccacagcggatcggaccagcttgttacagttgacccgagccgctgtgagtggtttgctgcagcgccttaggctttcgccttcagcactcgcgcccctctctcataggtgcaccgacccaacttttgtaaacccgccatcccatctcttctaagctaccctgaaggctatatcgcctaagatactggagaaggagatgtccgggatgtacttaaccttatatattatccctaagtagtagtatttaaattctttaaatatatatataatagctataaattctttattatagatagcttagaggcgttcagccattatccagcagatggtagcttcgcggcactgcccggtcggacagccgcaaaaaccaattatctgaaagtcaggagcatacctcctccataaaatcacacgactgatcgacgatcttcatcagcgacacgtccgggttgaaatcagatggatcccgtcgcaccaggggatacggaaaccacatcattgatgaggatatgagcgcccgctttcagagctcctatatgtgcccgcagtatctcaatacaacgaatgtcgctccagttatgaaagataaactagagtcaagctcaacagggtcttctttccccgctgattctgccaagcccgttcccttggctgtggtttcgctagagagtagatagggacagtgggaatctcgttaatccattcatgcgcgtcactaattagatgacgaggcatttggctaccttatgtgttgtgtgtgaatatgctttggtggcattcccagtgaggtgcatgtgctgaagtttggttcccggcgatgtgcatgtcctggagcccaagcactttgatttctcgtaaggtgccgaacgagtcaatttttaacatcgtccgatccctagtcggcatcgtttatggttaagactacgacggtatctgatcgtcttcgatcccctaactttcgttcctgattaatgaaaacatccttgacttacagcgcttcccaccctctaaaacaataatttaccgcggctcttaacaacttttttgattttacataccctgcagcagggccggtctactgagcgtgagctacaggcggtgagatagcctgtggggtgcaggttatgtgaggtgcaggttatgtagagtgtaggtcatgtgaggtgcaggttatgtaaagtgtaggttatgttgagtataggttatgtaaagtgtaggttatgtttctctatcacctggctgagctaaggttggttttccatatctatccgagcttgtaacaaccatggtggttgagattatgcccatgggtttgggagttgtaaactcggtaatgatccctccgctggttcaccaacggagaccttgttacgacttttacttcctctatgcccggctagtggctgcctgctcccgaggcgtcctcccaaagcccaacgtacccaacccttagagccaatccttatcccgggcacgacctgtcgtatagctcgcactgaaagacttctccttgccagatcaggccttcatcgatgatcttattggcatcctgaggcctggtaaactccacgataacagaggaggcactcttcgtcgagaatgtccttgtgagccatccgatatatttgattcccgcatttgggatgaatggttaaattagtataattttctgatctctctcacaaaaataagattcttttgcactatattttgcactatattaggtccctctagtactaaaactcactgagtggctggccgtggtgttatcctgctcatggtcagcatcggcagaaacatgcctgataacgacctcgccatgggaatgaccgttgaagaggcgtctctccacctcaacaatcttgccccgaaacagcaccttggctgactcttcaccacccatctcctcaatccggacaaatcgtgggcgaggttgtgtcggcccaagggttgtatgatgaaatttgcagacgcgcgatcggaaatgatgcggggaatcattcttcgaagagcaataaggtgctaaggttctcgtacagcggacacgaggtccgctaatgcaagcgctacagcggacacgaggaccgctaatgcaagctgttgaatttgagagattatagccactataagttagtgggttcagattgctgttagcgatcacaaccactagcctctagccatagggaagttccgtttcaaaggcgcactttgcgccgtgtggcgaaagggaagccggtcaatattccggcacctggctgtgggttttgcgcggcaacgcaactgaacgcggagacgacggcgggggccccaggcagccttgcagagcgcgaacctcagtccaccccagggtattacacagtgggctataacactcccgagggagccacattcccacagcctttatcccccggggcgaactgatgctggcctgggcaggcagagtgcaccgcggagaaccacggatgatcaacctgagattagataatatataatctaatatatattttttaagaatataattagtagtttatatctaaacttttaatactataagataagaaagttaggggatcgaagacgatcagataccgtcgtagtcttaaccataaactatgccgactagggatcggacgatgtgaaggaagagcccagcacctctgctgggtctggtgcgctctcgacgtcccttgaaaatccgcgggaaggaataattctcacgccgcttcggtatgataggaagagccgacatcgaaggatcaaaaagcgacgtcgctatgaacgcttggccgccacaagccaggtatccctgtggtaacttttctggcacctctagcttcacacgtcgaaggactaaaggatcgataggccacactttcatggatatgctttggtggcattcccagtgaggtgcatgtgctgaagtttggttcccggcgatgtgcatgtgctgtggttggatgtgtggtggtgcatgcacgctgtggtggaatttacagtggcgtgcattcgctgtggttggatttgtggtggtgtgggtgcaagagatccagctgggaagtatcaaggtactttttgatgagctgatgaataccctcgcctcgagacgtaaccacatttttaaagtgaaggtgctcatcaacccaagctttgacaagcttctttttgtgtagatcaagccatgtttcgatgatgtaggcgtggatggagtgagtggcaggcgggtcgagatttgggggttgaaggggagtaatcattggggaaggactgggaggttagcgcaagggtgggtttcactcaaatccaaccacagcgaatgcacgccactgtaaattccaccacagcgtgcatgcaccaccacaaatccaaccacagcacacggcaacagctcaaatttgaaatctggcgcaagcccgagttgtaatttgtagaggatgtttctggcgacgtgccttccgcgttccctggaacgggacgccatagagggtgagagccccgtacggttggatgcctagcctctgtgaaactccttcgacgatctccgagagaccgttggaatatggatgaagccggtattatggagggagtcagaggtaacgggctggtactaggatcattaaggaagcaatataccctcctgaagcagtcaggatctcgcgatttagtaactgctgttgaatctatcaatgccctaggtcagggccatgcgaggcaggtgaggcagcgtgtgatgtatgtgccagggctaggcaggcaacagggttagggcgagatgatggagaggaaggggggataataagcacacgcagggccatgcgaggcaggtgaggcagcgtgtgatgtatgtgccagggctaggcaggcaacagggttagggcgagatgagggagaggaaggggggataataagcacacgagtgctattccggcagcagcagcagcagggtgttaggggtatatggctcagaacttaagcatatcaataagcggaggaaaagaaaccaacagggattgccctagtaacggcgagtgaagcggcaacagctcaaagaacttaagcatatcaataagcggaggaaaagaaaccaacagggattgccctagtaacggcgagtgaagcggcaacagcgcaaatttgaaatctggcgcaagcccgagttgtaatttgtagaggatgtttctggcgacgtgccttccgagttccctggacctcttcgcttgcattatcgggaaggcgccacttgggatacaagttcatgtgcggaggctggacgctgaactcattgtcgtcgttctggaagtagaagtggcaaagccggcaaaccgatttgctggttgcgacataaaactgagttcaatactgctatcctgagggaaacttcggcggaaaccagctactagaaggttcgattagtctttctcccccatgcccatatttgacgatcgatttgcagacattggatagcaaatgaattagctgtaattctggatggcaaggaacacatgttggtcatggatgtagccagcttccatacgactgacgacgtacttcaagacctacgatctcgtaagattacaacagccctgatcctgcagcacgtacggcgtggtataacaagctgcctcgaggtagcttgaagactaaccagcaatatcgaaaggcaatgggctttcctcaacgctacgataaagcaagttataattggtgtttggactataagcagatgggtaaacgatgcatagggcgtggtgttggggatcggccaaagcccgcgagggacggccggcccctaaatctagtggcggacccgtcgtggcctcaattcttgttttattttggaatcttctgagtagtttttacaaataaataaaaactttcaacaacggatctcttggttcttgcatcgatgaagaacgcagcgaaatgcgataagtaatgtgaattgcagaattcagtgaatcatcgaatctttgaacgcaagcttgaattatgccatatgtggcacacaacaacttagctgactccggagattacattcacttgctgtgctctcgctacgaagagcttgaattatgccatatgtggcacacaacaacttagctgactccggagattacattcacttgctgtgctctcgctacaaagaggtggcggcttggaatggatcttagcagcctctatggctacttcgagcttacctggaaacccttgcaaggtacgattgcagaggatggtaaccgattaggtatcctctcctgctgttaaggcgttaacaatccccacgttgaccatggagtttaacgtaatccacaagtgagcgggccacacaagcgagcgggccacttccttatcgtaccttaaatagcgttttttctaactgcacctcacatgacctacactttacataacctgcacctcacataacctgcaccccacaggctatctcaccgcctgtagctcagtgaaccggcagacaaggccttcacctgtcttaatgccagtcatcaacccaccaccggccttttcaatttcataatcatctcgcaccatcgtggcttcggcttgtggcagatgttcaagacagtggtccttctcgaagaacaggttcgtgcacggcgcaaggccatgcgattcgagaagttatcatgaatcaccagagagccccgaagggcattggtttttaatctaataaatacatctatctgatgctccttgcagaatagctcgaattctgttgagtggtggctttcgtgtccatccatgattagaagacgatatgcgccttgagttcgcggcttagtgtgcttttcaaagtgctggatccattctacacccttttcatttgacgtccagccgttgtgagttgtggagatgacccaataacttaccactgagcaacgggagatcgccacgtgcagcggacaccgccatggttgaagctgtgcgctgagcactcctctgggggcgcccaagccgcaccggccctagtggtcttggtgtggtggaaggatgccctggggaactgagagggggaaggtgggccgtctagcctgtccaagtgaccactcagtgggaatctgcaagatacggtacagttgaagagatttcccacagcggatcggaggaggccatatagggatggcttcactgaataccggcatgagcaggaaacccatgatgccaccaagccattgtgggggggcaacccacaagaccctcgttccgtgaattccggtaaacatcaagcccgggaagcagctttagcgggttttagagtagtttttagtcggtagatctatgagagaaattagtataattttctgaaaatacttcaatgagaacttgaaggaccgaagtggggaaaggttccatgtgaacagcggttggacgtgggttagtcgatactaagccatagggaagttccgtttcaaaggcgcactttgcgccgtgtggcgaaagggaagccggtcaatattccggcacaaatacttcaatgagaacttgaaggaccgaagtggggaaaggttccatgtgaacagcggttggacgtgggttagtcgatgctaagccatttagagagggaggagatattagatatagtaaatttaatttaactattataactattatcttttatttaaaataactaacgtgatccaccaccatgtgggccataccactatgtgggccacttttttaaactttataacttctaattatttttacggttgacctcagatcaggtaggaatacccgctgaacttaagcatatcaataagcggaggaaaagaaaccaacagggattgcaaccgctcattcagataattggtttttgcggctgtccgaccgggcagtgccgcgaagctaccatctgctggataatggcggaacgcctctaagtcagaatccatgccagaaagccatctcccaaaccccctacgcagccagccaccagggccgcctgtattggggaaatcgaggcgaaggacggcttaccctcagcatctcccaaaccccctacgcagccagccaccagggccgcctgtattggggaaatcgaggcgaaggacggcttaccctccgcagatcgtaacaacaaggctactctactgcttacaggaccgtttcgcacagctaagtcgtctgcaaaggatttgaccccagcgtgcatgcaccaccacaaatccaaccacagcacatgcacatcgccgggaaccaaacttcagcacatgcacctcactgcagcgtgcatgcaccaccacaaatccaaccacagcacatgcacatcgccgggaaccaaacttcagcacatgcacctcaccgagcctgtgaggagcagactgaagtcttcgtttgctgcaaatccgctcattgccttcgcaaagcgttccattcgaaccgggttctcaagaagaaagtcgtacattcccataggggtattgtttgctaaactgaagccctttgtggaggttagcaggattggtgtcgaaatggtgttgaaggcttggcagttcgtaaaactgaccaatgaaatagtgtacgatgtgataaatcggggagattttgtgactaccacgtatcttaggcgatatagccttcagggtagcttagaagagatgggatggcgggtttacaaaagtcatgtatatcggtcgcgcaataaatactgatacagggttcttttggatcttgtaattggaatgagtacaatttaaatcccttaacgaggaacaatttgagggcaagtctggtgccagcagccgcggtaattccagctccaatagcgtatattaaagttgttgtggttaaaaagctctggtaattgagcttagtacgagaggaaccgctcattcagataattggtttttgcggctgtccgaccgggcagtgccgcgcagctaccatctgctccaatatctccgccaagtggctaccgggtattctaaaaggtttaaaagagatcaataatgagacttcgagaaaaatcaaaccaccgtttccttgctcgggaccctaatttatataggaaatcatcgtgaaaagcgtatccgagaccattgggatacctacaagccggggtcaatgaagccaacccaccctatttcatttatcccccggggcgaactgatgctggcctgggcaggcagagtgcaccgcggagaaccacggatgatcaacctgcccaaggctggttatagggtagcctgggtataggttagatcgtctgagaatatcctaggatttttcccggattttctagaccctatcattaatgccacgacggttcctagtaggatccgttgaaatttggtgggtgaattttcacgctactaaaagggcttccctttcgccacacggcgcaaagtgcgcctttgaaacggaacttccctatggcttaggatcgactaacccacgtcatcaaagttgtataggtcctcatctaggatgccgtattttgccttcaggttgcgtacgagagtaaaccaaggtctaataacctttggatcttcgcatttcacgccgtcaaagaagagagtacttggagcttatcgctcgtagtactcccccttcgactccaaagagccaacccaaaatgtctcctaagagggtttaatggccggaagagcccagcacctctgctgggtctggtgcgctctcgacgtcccttgaaaatccgcgggaagggataattctcacgaacggggaacctagcgaatggcctcggcaaccgaagaggctacggcgcgctcaaaaaaggcataacgcgctccgggtgtaactcagtcattattaagcagtgagcagccgaggttcaacacgacgagccagggcctgtttttgtccttatctattttgctttggttcccggcgatgggcatgtgctgtggttggatttgtggtggtgcatgcacgctgtggtggaatttacagtggcgtgcattcgctgtggttggatgacctatgaataatcctagggatataaggtagaaatataacttgggctcctttcacagaagttggtctgaaaataactaactaatgtgtgtaagacttagatactatatagaactagcccagccctaacatctactaatatatcctctccctaacatgacctatgaataatcctagggatataaggtagaaatataacttgggctcctttcacagaagttggtctgaaaataaccaccagcctgcctggtcggcatggtcatctggtgtcaattcgacagcttgccttgctattttgatagcctcttctaggtctgccatctcgcctgtccgcttgtaccaggatttgaccccgctcgttttaaaattacaatacgcgaaatactacagcacacttctagtaccgtagagtaatcgccttctcaggctccttctccggggtcgagccctaaccctccgttacccgttgcaaccatgtttggccaatacccaaacatcgaacgttgatagggaagaaatttgaatgaaccatcgccggcgcaaggccatgcgattcgagaagttatcatgaatcaccagagtccaacttgcagagggaactgacctggagttcaacggcggaaggatatccctccacggcacaactatcaagttcgtgcagaaaggccaagccaacgcgttacaaatagccacaagagacccaaacgcggagagctacaagtcccaaagagcacgaggcgcgtggatcgcgagtatagcacaaccagaggcttcgtatgacctatctgtagcggcacagacccaacagaacccgtcagaagaggatatcaacaccatgatcatgcaagcacccggccagttacagggcacctaccctactaaaacaacccacaacagtatacataagcaactgccatgatcatgcaagcacccggccagttacagggcacctaccctactaaaacaacccacaacagtatacataagcaactcgaagtcagccatagcgtgtatcaccccgctaaaattccaaccccagcgcacccaacccactacataatcaaccacagcgctcccaaaccccctacgcagccagccaccagggccgcctgtattggggaaatcgaggcgaaggacggcttaccctcagcagtcgaaccttctagtagctggtttccgccgaagtttccctcaggatagcagtattgaactcagttttatgaggtaaagcgaatgtgaggtgcaggttatgtaaagtgtaggtcatgtgaggtgcaggttatgtaaagtgtaggttatgttgagtataggtgatgtaaagtgtaggttatgttgagtataggttatgtaaagtataggttaggtggcgtgtgttgtgtgtgaatatgctttccttgattttgattttcagtgtgaatacaaaccatgaaagtgtggcctatcgatcctttagtccttcgacgtgtgaagctagacagacgttatcggtgcccctggcgaagaggtccaggcgtttcaaaccccagctgaccgccgagatcgggctagtcaagacacctcctctaccttattccaccccttgctcgctctccagtgaaccgcacacgctgaccttatgattcttctccccgcataagaagcagcggtccatcccctctgctagctgccgccggaaatgctctacctcccctgcccccttcctgacccgctctgcactgagccatatacccctaatgatctctcgagcgctcgtgaagcagggagacattagggcgttcttggtccatccagaggtggagaagtggctacccgaggccgacatgttgaggggggaaaagctgaaggaattattcaagatctaagacctagtctagggtaggctggttatagggtagcctgggtataggttagattgtctgagaatatcctagggaccctccccgtcaagaccgaagagctgtggggcttctgtgccagcaacagccatgggccgcgacaccatatcacctatggccgatacagttcaacaaagcggtaggcatgatctcatctgatccgttcgactgcttgccggttcagatgcagtcgtgaaacaaatataagcataacataaggcaccagcactcatgttgcccagagatggagggtagctacaccaagacacttacaatagttatatcgaaggagcattgaagtatttgctactaccaccaagatctgcactagaggccgttcaacccgggctcacgccctaggcttcgtcactgaattgaagtatttgctactaccaccaagatctgcactagaggccgttcaacccgggctcacgccctaggcttcgtcactgccctccacgtccgcctactcctcagggcatcgtttctaccctgagggcgaggtatgggtgagacgcttgagcgccatccaattgaagtatttgctactaccaccaagatctgcactagaggccgttcaacccgggctcacgccctaggcttcgtcactggcctccacgtccgcctactcctcagggcatcgtttctaccctgagggcgaggtatgggtgagacgcttgagcgccatccacgccttccacgcggatcggagggaagtgagaaggccagtatttcaaagagctcgcgaagctgattattctgaccaccacgtcaaaaaaagtcatgtatatcggtcgcgcggtttggtggccgtgagtcgatttttttgatttcccatacaaatgaatttgcgggagtaactatgactctcttaaggtagccaaatgcctcgtcatctaattagtgacgcgcatgaatggattaacgagcttcccactgtccctatctactatctagcgaaaccacagccaagggaacgggcttggcagaatcagcggggaaagaagacactctcataggcatccactgccaatatactccagtgaattattggacatgaacaactcagaccctttcgataccttgccaattaaaatgacctcaaactccaaacggcttttgcactattgtacgtgtgtaggatctcgcaggtacaacagcagctgatccacgatggctagtccagcacctcagagtcgacttcgaaacctgccctaaagggttggagacaggctggtaagttagacacttttagtcgtgagttatatgttttaagacgatagtttacaaaaaatgaattagattcctgtaagcgtatactatgcttaactcgccgttctgattattagattatcgggtcaaagcaaaaccctttacaggttcgtcagaaggatgagattatccaaggcaagcctcctcgttacagcccgcagtggccgttgcttgaagaagctctcagaaaggaattccaccaggctaggaagctaggtaggctacttactgttagctggttcaagaggaaagcgtacaagcttttcggttcttttggatcttgtaattggaatgagtacaatttaaatcccttaacgaggaacaattggagggcaagtctggtgcgagcagccgctacataagcaactggaagtcagccatagcgtgtatcaccccgctaaaattccaaccccagcgcacccaacccactacataattaatcaggaacgaaagttaggggatcgaagacgatcagataccgtcgtagtcttaaccataaactatgccgactaggtatcggacgatgttaaaattcgcaacaagatcgacctctacatcgtgccaatcgtagccctgctctatcttttctgcttcattgaccgtgcaaatatgggtgagtgatcactctgtctctacaagaaattgtagagactggctgttgcaatgactgcaaactaactcatcgtgaataggcaatgccgcttccagtggcaaatcgaatagcttctcgtataaaaattcattgaattgacgttgttgtgttgatttttgaatctatcgcgattttcatctgggtgttgccgttgagcctctcggagactccgccgccatcgactgggtttgagggacgtccttctcccctctggttgtgatttctgagagccagattcttccgtttgtacccgtggccggcatgaagctgggacctgccggcagcgctgcccacaaatcaaatgcaatcaaacaaacagccaaacaaatcaatcaaatatgccagaatcttatctcaagttgttaagagccgcggtaaattattgttttagagggtgggaagcgctgtaagtcgaggacagtggctagatacagggatgggcgtagttatctcagaagaggagggttcgtgagctggcgacggcgtgttgagaggttgacgattgagaatatcctttataataatgttgcgttgccgcgcaaaacccacatccaggtgccggaatattgaccggcttccctttcgccacacggcgcaaagtgcgcctccggccccgtatgctcttactcaaatccatccgagaacatcaggatcggtcggagatgcgccgaagctctctcctacgttcatgacttgcgcttactagggattcctcgttgaagagcaataattgcaatgctctatccccagcacgacggagtttaacacgattacccaggcctttcggccaagggagtactcgctggctccgtcagtgtagcgcgcgtgcggcccagaacatctaaggacccacatttaccctcgtgcacgccacggtcggttcccgggccacttttgattttccgcaaaattcatttgtatgggaaaacccacatttaccctcgtgcacgccacggtcggttcccgggccacttttgattttccgcaaaattcatttgtatgggaactcaaaaaaatcgactcacggccaccaaaccgcgcgaccgatatacatgactttttttgaagtggtgacccacatttaccctcgtgcacgccacggtcggttcccgggccacttttgattttccgcaaaattcatttgtatgggaagtcaaaacccctctctcataggtgcaccgacccacatttaccctcgtgcacgccacggtcggttcccgggccacttttgattttccgccattacggaaggttgaggcgcaaaggaagcggcttcagcaggacagacttcccgcctgcacaggagtcttctcagcaacgcttgggctcccttgcgctcacgtaatcgactaccaccaagatctgcactagaggccgttcaacccgggctcacgccctaggcttcgtcactgacctccacgtccgcctcctcctcagggcatcgtttctaccctgagggcgaggtatgggtgagacgcttgagcgccatccattttcagggctagtacctaccaccaagatctgcactagaggccgttcaacccgggctcacgccctaggcttcgtcactgacctccacgtccgcctgctcctcagggcatcgtttctaccctgagggcgaggtatgggtgagacgcttgagcgccatccattttcagggctagtaccgaacaccaacaccaccagagaccctgcctgagataaggcagccctgggttctaaagacaccacagactgcgtacgaggcaagcgctgagcactcctcttggggcgcccaagccgcaccggccctagtggtcttggtgtggtggaaggatgccctggggaactgtggagggcaagtctggtgccagcagccgcggtaattccagctccaatagcgtatattaaagttgttgtggttaaaaagcgcgtagttgaaccttgggcctggctggccggtccgcctcaccgcgtgtactggtccggccgggcctttccctctgtggaagagtagccttgttgttacgatctgctgagggtaagccgtccttcgcctcgatttccccaatacaggcggccctggtggcgggctgcgtagggggtttgggagatggattacaaggacgccagagttctggcgcccggtctgtctctcgggaagcggctgtatatactataagtgtaataacaattttatatgctagtgtaagtacaataagaactacagatattaaagaattaattgcttacatattatgttcctcgatgatcgtccgcatcttccacttgatcctaaaagtaccatgctgacgaaagccttcctgccaaacggtaggcggcggggggcctccccgatggggtgagccgctcgcttcctgatacgttagactctcttccaacaagcacctgcggataaagtatagagccttgctggtgatggatgcttgaagtactggtttggtgtctcatcccttctgtcacccacttgatcgcgtattgcaaatacgcatttcttaacgcaataaaattcgtaaattaaaattgaagctattcaagttgccaggtgaatcgatgccagaaccaagagatccgttgttgaaagtttttatttatttgtaaaaactactcagaagattccaaaataaaacaagatcgatgccagaaccaagagatccgttgttgaaagtttttatttatttgtaaaaactactcagaagattccaaaataaaccaagaattaagtttcctaggcgggcgcctgatccggggcacacgaggcgcccggggcaatcccgccgaagcaacagtagggatgaatcgtaggaaattattgacgattggaactgcctcttctggggtcttcgtagcccttcttgtgacccgtcttcttgagaggttaccagagaccgatagcgcacaagtagagtgatcgaaagatgaaaagcactttgaaaagagggttaaaaagtacgtgaaatggttgaaagggaagcgttcatgaccagacttgggcaggttgatcatccgtggttctccgcggtgcactctgcctgcccagtggcccgcattggcaactggcgtaaggcattcccctcgccttcaaaccaagccggcgaagtgtcggggggcatgagcgtgtcgcgcccacaccaagccgacgacgaggcagccgagaggcggcagtaccgcgcccgcgattacccaggcctttcggccaagggagtactcgctggctccgtcagtgtagcgcgcgtgcggcccagaacatctaagggcattcttgatacctccaaagattaacattaaaatcatggatagtattacataggcttgaaataaaattatatgcatacttcttgctatcaaatatgcacagccttaaaataaacttaaagtattacattctccctagactatgtgtctgcaagggttagtcttcagcattatatcatcgcaatttcggaattctggggcagatgcttcaagacagcggacagtctgatgagcacaagcgggccggaatgctgtgtacttgagaatccttcaactcgaccccacgtggcacgttgaataaaaatcatattcccgcagcccaagatttcagatcaacattatagggccccctagccatctgattgaaatcacgtggatataaagatgattttttttaaggctacctggtggattctttagaagctgccaccctctggggaggggcgcaacggaatttgtaactcaggacacttttgtaaccctcttaacgtattataaaaagtagtttattctattatgtatatattatataacagttattgttatataacttattatattacttattaatagattattatataatagttattattatataattctttatagctagccgaagccgtctagcctgtccaagtgaccactcagtgggaatctgcaagatacggtacagttgaagagatttcccacagcggtgcaaggcaataagaaaatgcggctactgcgctcaagaccatgggtcccgcgagtgtcccatgaagtctgacaggagccgcgtacctcggaagtgtgctaactgtcaaggtcatcatgaggcatggagcaatcagtgtacagacagaaaggaggagatcgacgtcgctatgaacgcttggccgccacaagccagttatccctgtggtaacttttctggcacctctagcttcacacgtagaaggactaaaggatcgataggccacactttcatggtttgtattcacactgaaaatcaaaatcaaggggacttttacccagggttgtatgatgaaatttgcagacgcgcgatcggaaatgatgcggggaatcattcttcgaagagcaataaggacgccgcttatcagcccataactccacaaccacacgagttagactatggccaatacctggaagcatttgatcaagtggattgttcacataaaaaattatattttatttatgtatatacgagatacaaataatcttacaattcttggtaatatatatttagataaaatatataatattaatacgattaaaccaaaagaaaatacgatttcattacacgttttcaggctcgtgagtgagcgaaaggctatccagaatgcagtatggtctgcccagcgcgagtgaaatcatccgatccaggagatatagatgacaccatagtcgacgtcgtgcctcggtgacccggcgcggcaatttccaatgagttccgtcgaagggtaaaactaacctgtctcacgacggtctaaacccagctcacgttccctattagtgggtgaacaatccaacgcttacagaattctgcttcggtatgataggaagagccgacatcgaaggatcaaaaagcgacgtcgctatgaacgcttggccgccactaacctgcacctcacatgacctacactttacataacctgcacctcacataacctgcaccccacaggctatctcaccgcctgtttgctttggcagtacgctggcttcttagagggactatcggctcaagccgatggaagtttgaggcaataacaggtctgtgatgtccctggaacgggacgccatagagggtgagagccccgtacggttggatgcctagcctctgtgaaactccttcgacgagtcggtataaccaacaccggtgggtcggtttggtggagggcgaggaacgttgggaggaggcttcgctctctcatcaagagatcgtcggcctcggcctccaccctccataatgccggcttcatccatattccaacggtctctcggagagatgtgtttgatagccggatggttcattattgcgaagaaatcctaaaagtcatgtatatcggtcgcgcggtttggtggccgtgagtcgatttttttgatttcccatacaaatgaattgtgcggaaaatcaaaacagtgggaatctgcaagatacggtacagttgaagagatttcccacagcggatcggaccagcttgttacagttgacccgacacgctgtgagtggtttgctgcagcgccttaggcttgttatgttatgttatgttatgttatgttatgttatgttatgttatgttatgttatgttatgttatgttatgttatgttaggaggtggatccgacaattcgattgctgttccgtaagatctgtaagggcctggatgaacagcaaatacagttatctatctcaacggcattcccagtgaggtgcatgtgctgaagtttggttcccggcgatgtgcatgtgctgtggttggatttgtggtggtgcgtgcacgctgtggtggaatttacagtggcgtgcattcgctgtggttggatttgtggtggtgtgggtgcgctgtggttgattcccctgctgcctcgtctggggcagcctgatagaacagcttccgatcttctaggtgttctagcaagtatcccatgcctgtcatcacctcccaaagtcgtccattacctccctcgctaccccacccctgcgttctcatggcagattcgagtggtcaactatcagttcagatcagatttgggtcctaatctgatttgattgatctgacggcagccctgccgagacctaactgaatctcattggttggcttcatattcacctcgcgaactgaatgtcattgatgacccgagagatgtccagttgatcaaatgatcccaggttagtatagggtaagaaggaatgaaataactaacttagggctttccaaagctggaagtcctctggagccaccggcccaagaataataaaataggacgtgttgttctattttgttggtttctaggaccgccgtaatgattaatagggacagtcgggggcatcagtattcaattgtcagagggtctcctcgatcgaagagacccctggtttaagtaccaagtctttactccgatggatgatcgatcagccagatcttcattgcactatctagaagatcagttgcggcaagcccccgccgtcgtctccgcgttcagttgcgttgccgcgcaaaacccacatccacgtgccggaatattgaccggcttccctttcgccacacggcgcaaagtgcgcctttgaaacggaacttccctatggcttagtaagaattaatttaattattactaatatatataaactatagttataaatctaaattctagaattaattagaatttaataaattagatatactagctgctatacttataaaagaaatattatacttattatatactaaaataaaaatagaactagaatttctcaataaaggtggcgtgtacaaataagtcttgcctaattcttgcaccaggcatttgaaaatgacccggcagtcatcatccgcatttctcgcttaagcaatttttgagggtgggaagcgctgtaagtcgaggacagtggctagatacagggagggccggtctactgagcgtgagctacaggcggggagatagcctgtggggtgcaggttatgtgaggtgcaggttatgtaaagtgtaggtcatgtgaggtgcaggttatgtaaaaagaattaagtttcctaggcgggcgcctgatccggggcacacgaggcgcccggggcaatcccgccgaagcaacagtagggatgttcacatgggtttgggagttgtaaactcggtaatgatccctccgctggttcaccaacggagaccttgttacgacttaagaattaagtttcctaggcgggcgcctgatccggggcacacgaggcgcccggggcaatcccgccgaagcaacagtaggtatggggccgcctggattggggaaatcgaggcgaaggacggcttaccctcagcagatcgtaacaacaaggctactctactgcttacaggaccgtcttcccttatctacattgttctatcaaccagaggctgttcaccttggagacctgctgcggttatgagtacgacctggcgtgtaggttaggtggcgtgtgttgtgtgtgaatatgctttggtggcattcccagtgaggtgcatgtgctgaagtttggttccaggccatcatcgcgccgatggcgagcgagcaaattctcgttcatgaagggaatgtgaaggtctccgcccgcagccatagccggcaggctggccgtggtgttatcctgctcatggtcagcatcggcagaaacatgcctgataacgacctcgccatgggaatgaccttcaaggatctgtcacagaagagatagctatcgatctgcaaagaatgctccaagctactcatttagatgggtttatattagaggaagtcggactgttgcactatgcgtgtggctttgtctcttgcttattacaagtcaggggcgaaaacacacaatactgctcgattgaactttagtattagctgtccagggacacctgggactggtggcttttcctgtagccgtttatgcgtggtaacggtcccgagactcttggtaaacttcaaacatgtgactggttttctatgctcctaaaacgccctggactcttttcggccaccttgagcacaggtggagaggatcgactaacccacgtccaaccgctgttcacatggaacctttccccacttcggtccttcaagttctcattgaagtatttaatatattattttataattaaattagaataagtatttagtataatagatttattttctattaaattactagattatagtaaaatattaaatattcttataatctatatatattttaattttatatatagttataagatactcctaaagttagagaacttattccctaaggagtttaacttcagtattattattactactgctgctactattactattatccttatctattatattattatatagaataggtagattattagtagtagtaggagtatagtacttcctgtggttgcacggcaacatggagttgccgtcactcatcgacaacatcgccgaccctcgagaggaagagtatcgtgcccgagtgctacgctacatagactcggtctttcacgagtgcttggatgaggacgctggaaagactctccgccaggagcggaagcccactggctattagtgatcaaattagctgttaaagaccgctattagcggtcccagccactggctgttagcgatcgtagctactagctgctagcgatcccagccactagccgttagcgatcgcagccactagctgctagcgattgtaaccactagcttctaagacgactccttggtccgtgtttcaagacgggtcgttgatgaccattacgccagcatccttgcagagcgcgaacctcattataagcgctagagagctaggtagatctatattaaggctggaaaaacttaaagcttattagagataacggtttctcatttgcttgattttacgagctgatagtgtttcaggttatttcggttgggatttaatgacgttgagagtttatctcttatataagctgcatctacttcccacctatctagtttatctagctcgtagttgaaccttgggcctggctggccggtccgcctcaccgcgtgtactggtccggccgggcctttccctctgttgaaccctatgcccttcactgggtgtagcggggaaacaggacttttactttgaaaaaattagagtgctccaggcaggcctgtgtagcgcagcaaacagtatggtaacatcgcctcttatccgacgtattgtatatcgtcgtccgtattgacctacattcgcagagatgctaagtgtgttacagaggtcgtgatcgcaaatattgccgtcgatcctcccaaaaatagttggagcgagctgtggaagatctggattttcattggtactcaaatgagaaaaaacacacctttgcgaaacagggccaggcttcttcggtaaatagctcagcaatatcagccattgattgatcctctttcaatacgcgcgaggcaattgtatgtattatttcgccgttcctctcctgaaagatatgactaagcgttgcacgctttagcactcgttcgatatcaatcctatcaaggcccgtgacttttgcgaggtcatcgtatgacatacttccatctttaggaaggattttcgcaatcggaaaccagctactagaaggttcgattagtctttcgcccccatgcccatatttgacgatcgatttgcacgtcagaaccgctgcgcaaaaatttcacctctgacaattgaatactgatgcccccgactgtccctattaatcattacggcggtcctagaaaccaacaaacatgaatgcagtatctcattgcttcccggctgcggtgtcgcttctatgcctttggcatgccaacaaggcagttctacgttactgtcagccaagttttatgcgccataacaatttttaggttccattacagagagggctccttgggttggaccagcgtcagccagcccggaactacaatccgagaagccaacttaattgggcgcggtgtgttttggcacctggaagcttgggctggagagataatttggagctttcttgcggtcctgctgttcaagcgttcatagcgacgtcgctttttgatccttcgatgtcggctcttcctatcataccgaagcagaattcggtaagcggtggattgttcacccactaatagggaacgtgagctgggtttagaccgtcgtgagacaggttagttttaccctactgatgacggccattttcccgaaactgcacagtctctgatggctcttcggaatcagtttgcgtactggcctggcgacggaggtgtgtccagcgccgaaaaatggtccagtagagtgccgtcaaattgatgtaggaccagtgcggcacatttgtaaagtccgtttgatagccaagcaaacttatataatgagccattcgcagtttcgccgtataattgcttatacttagacatgcatggcttaatctttgagacaagcatataacttatataatgagccattcgcagtttcgccgtataattgcttatacttagacatgcatggcttaatctttgagacaaccatatgacctgtacgtgcgggtggtatcaccgctttctggcatggattctgacttagaggcgttcagccattatccagcagatggtagcttcgccgcgcccctctctcataggtgcaccgacccacatttaccctcgtgcacgccacggtcggtccccgggccacttttgattttccgcaaaattcatttgtatgggaaatcaaaaaaatcgactcacggccaccaaaccgcgcaagtgcttttcatctttcgatcactctacttgtgcgctatcggtctctggccggtatttagctttagaagacgtatacctaagtgcttttcatctttcgatcactctacttgtgcgctatcggtctctggccggtatttagctttagaagacgtataccgcccatttagagcagcattcccaaactactcgactcgtcgaaggagtttcacagaggctaggcatccaaccgtacggggctcgtccttcgcctcgatttccccaatacaggcggccctggtggctggctgcgtagggggtttgggagatggattacaaggcgccgcgcacggcaatccaccttccccctctcagttccccagggcatccttccaccacaccaagaccactagggccggtgcggccgccgcgcacggcaatccaccttccccctctcagttccccagggcatccttccaccacaccaagaccactagggccggtccggcttgggcgcccctcaccagcctagcaggttacccgctcaacctcttaccctatatcaaatatatcaaatgtcatttcaaatccggtgtttctcatttgtttgatttgggataagattctggcatatttgattgatttgtttggctgtttgtttgattgcatttgatttgtgctgcaaacgcgcctactgagattgtaaagattgtaaagattgtaaagattgtaaagattgtaaagattgtaaagattgtctacgcacctgggtgcgcacgtaagtgtcacgtgttgcgcacccggtgcgcgtgtaaggaagttatgtaagcctaatctcttctgccacagcaacgaacatgaccaggttttgtcgggtgcggagtatataaatcctgattatgataaacgtctagagtggggaacatgatgaaggcaccttgaaagcgacgccactcgggcttccgctcaaggactagttcataaaggtccccatccacgtgttccagccggtagccaagacgctcatcgatccaatagtatctccactctcgagtttttatctttataaaccttatactatagttctttatatatttctactagtagttctttatatatatatttaatagggtattcttctattttgattttccgcaaaattcatttgtatgggaaatcaaaaaaatcgactcactgccaccaaaccgcgcgaccgatatacatgacttttgtaaacccgccatcccatctcttctaagctaccctgaaggctatataagaagggcagagatcaggccgggcaactcacccgcggtcgccgacctcgcaagcgttcaccaatggacagtgacagaatcaaaaccataatggataagaagggcagagatcactgagattcgggatttaatatgctcagactgtgcggttgcctcgtacgcagtctgtggtgtctttagaacccagggctgccttatctcaggcagggtctctggtggtgttggtgtttgctcgggaccctaatttatataggaaatcatcgtgaaaagcgtatccgagaccattgggatacctacaagccggggttaatgaagccaacccaccctatttcacaatttatgagctttaatacctttcaggagatttaccgtgccttccgcccttatgctggttgtggtttctgcctacccggtaccccaacttcaaaccggtctcccgccttccacgcggatcggagggaagtgacaaggcttaagttctactttctttatagaattaaatatctatagtataggttctaaaagtatttaattcttaattttattaaatactttttattatttatgaactctgcctggggcccccgccgtcgtctccgcgttcagttgcgttgccgcgcaaaacccacatccaggtgccggaatcttgaccggcttccctttcgccacacggcgcaaagtgcgcctttgaaacggaacttccctatggcttaggatcgactaacgctgagctattcaatcacgacacaaaggtcagctaggtaggaagaagcagtcggtgtggctaggctgtttagttagacctgtcattaagagcagcaggaatgttacgcctaacgcgaccaaaaggctgatttgtcacgtgaccaagacgtacaggtatgacgagccaatcacagacggatcagtttggctcagaaagagcatagcgcacgtatccgtaggatgccacctggacagggaaaaagagcaccaggtccgttcaacagtacgcccacgatgggggaaggaagtgagcttggaaaagcaatttttatttaatttaatttttaattatactatatatttaaattaaaatagtattaaatattatttattattataataataaattaaagactatggaggaatcgaacctcatactaatgatttgcaatcatagtgtaaaagccatttacaacataatctttatgaggttaggcctgcccaacggaatacattcccttaatctcgcttgtcatggtatgggattctcaagacacgctctcaacctaacgggcagggtaataaatgccgtcagttggctacgtccattattgccttcgttctcgtattagtacttagggcatcaactcgtaagatcagccaaccatgaccgtttaagtctctcactcatgtggataccatctctggcccagaacgtggaggtcagtgacgaagcctagggcgtgagcccgggttgaacggcctctagtgcagatctcggtggtagtagcaaatacttcaatgagaacttgaaggaccgaagtggggaaaggttccatgtgaacagcggttggacgtcgataacgaacgagaccttaacctgctaactagcccgtattgctttggcagtacgctggcttcttagagggactatcggccgataacgaacgagaccttaacctgctaactagcccgtattgctttggcagtacgctggcttcttagagggactatcgggaaataaaagtatattctaagattagataatatataatctaatatatattttttaagaatataattagtagtttatatctaaacttttaagccctgggttctaaagacgccacagactgtgtacgaggcaagcgcacagtctgagcatattaaatcccgaatctcagctcatcaaaatagctctcaaggctatatcgcctaagatactggagaaggagatgtgcgggatgtaaagatagactggctaccctgcagccgcttcccgaaggctatatcgcctaagatactggagaaggagatgtgcgggatgtaaagatagactggctaccctgcagccgcttcccaagagatgtattagctctagaattaccacggttatccaagtagtaaggtactatcaaataaacgataacttatataatgagccagtcgcagtttcctacactttacataacctatactcaacataacctacactttacataacctgcacctcacatgacctacactttacataacctgatctgctaatcggccgcaacggctgtatatgcgaaaaagctgtagcttggggtcttccgtgccgtcaccttatccacacaaggctcttccacaaccgcacgttatccctagatgacttcgatcctcactggcaccgggaggcccccaagcccggggctgacgttcccttcgagccactgataattcgtggaaaaggaaggccccggggctccctcaacctcgataaaacacgaagcaatccacgcccaacgccgatatggacgacgtgcttgcccgtaactatgatacggagattcagattccgctgctgcatcgaagttcagacaccgacgcacatgggaatgctgctctaaatgggaggtatacgtcttctaaagctaaataccggccagagaccgatagcgcacaagtagagcgatcgaaagatgaatgcacgccactgtaaattccaccacagcgtgcatgcaccaccacaaatccaaccacagcacatgcacatcgccgggacccaaacttcagcacatgcacctcactgggaatgccaccaaagcatattcacacacaacacacgccacctaacctatactcggctcgaccagtggataaacagatagttaagatatagatataccaaaaagctataccttcttatttttggtagtaaaaataataccaataaggatatattataagatcaagttgtataagtataagcgggaggcccaattgatgccaacgcgctccgcgtcgcggtcgcgtaacagcaaattcgccatatcttgcacctcactccacaaacagggatcagacggagtcgcctataaaagggctggaaacagccagtagatagaaggaatcaagccttaagaattatattacctcgcatacaagtgaaggtaccgtgaacctaggtttcaaccataagctatccgactacggctaccctgtggcgcctcacgtcatggagtagttgtcgtgggatccaaaagaaaatctcattatgttcctcgatgattgtccgcatcttccacttgatcctaaaagtacgtggtggtcagaataatcagcttcgcgagctctttgaaatactggccttctcacttccctccgatccgcgtggaaggcgtgaacccctacgcgtaatgaaagtgaacgtaggagagagcttcggcgcatctccgaccgatcctgatgttctcggatggatgtgagtaagagcatacggggccggacccgaaagaaggtgaactatgcctgtatagggtgaagccagaggaaactctggtgaacggatctcttggttctggcatcgatgaagaacgcagcgaaatgcgataagtaatgtgaattgcagaattcagtgaataagcatgtgctgtggttggatttgtggtggtgcatgcacgctgtggtggaatttacagtggcgtgcattcgctgtggttgggtttgtggtggtgtgggtgcgctgtggttgattatgtagtgggttgggtgcgctggggttggaattttagcggggtgatagcatgtgctgtggttggatttgtggtggtgcatgcacgctgtggtggaatttacagtggcgtgcattcgctgtggttggctttgtggtggtgtgggtgcgctgtggttgattatgtagtgggttgggtgcgctggggttggaattttagcggggtgataatcgaaggatcaaaaagcgacgtcgctatgaacgcttggccgccacaagccagttatccctgtggtaacttttctggcaccagctgcattagcggacctcgtgtccgctgtagcgctcgcattagcggacctcgtatccgctgtacgagaaccttacagcggttacgagcccgtattacagaaggcaacgtgttttggaatgccaccaaagcatattcacacacaacacacgccacctaacctatactttacataacctatactcaacataacctagatctaagacctagtctagggtaggctggttatagggtagcctgggtataggttagattgtctgagaatatcctaggatttttcccggattttctagacccttatctgggctagataagcatttaaattagttttagtattagaataactatagtaattaatattctttaattatattattaaactattaaaatctaaagaactaatgagcattgctttggcactcggctcagttacctcgcggcctgtggatggatcctttatggctggcgtggttgtaggtgctagggcctccatgtacctcgcccacttggcgagtttccaaagcgactctggggattcagatgctttctcgaccttctcctgatggtctttcctgttaggcgatatagccttcagggtagcttagaagagatgggatggcgggtttacaaaagtcatgtatatcggtcgcgcgggttggtggccgtgagtcgatttttttgatttcccatacaaatgaattttgcggctattctacacctcctatgtcttttcacaatgtcaaactagagtcaagctcaacagggtcttctttccccgctgattcttccaagcccgttcccttggctgtggtttcgctagatagtagatagggacagtgggaatctcgttaatccattcatgcgcgggaagttccgtttcaaaggcgcactttgcgccgtgtggcgaaagggaagccggtcaatattccggcacctggatgtggggtttgcgcggcaacgcaactgaacgcggagacgacggcgggggccccaggcagagttctcttttcttcttaacggtctatgatacccagcctcgtataatgctgtatagactccctgagagttcgataggcgtccggacttgctgcttcgcttgatttgaccgtagttcagctacttggttaagtattgccagtttgatagccctccaggcctcgaagagatccagctgggaagtatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaacaacatcagcacggtcgtttattactgctactcgcagtgccgtcccgaaaaagtcctcatccttggaaaccttattgatatccaagttgtgtgaatatgctttggtggcattcccagtgaggtgcatgtgctgaagtttggttcccggcgatgtgcatgtgctgtggtgggatttgtggtggtgcatgcacgctgtggtggaatttacagtggcgtgcattcgctgtggttggatttgtggtggtgtgcgtcctattttattattccatgctaatgtattcgagcaaaggcctgcctggagcactctaattttttcaaagtaaaagtgctgtttccatcacgaggaccagcttctgcttccacatccatttctttgcctcggagaaaagagggagttttttgtcggaggagcgccaggtatccaagccgcaggctgaatgcaacgttgtgccaccgatatgtgccgctgcgctccccgacgttcccgtgatgcggagaagatgcgcgggaactgaccgtggcgtgcaagagggtaaatgtgggccggtgtatttctgaagagtacccaggctcatgggagggcgtcgggaactgaccgtggcgtgcaagagggtaaatgtgggccggtgtatttctgaagagtacccaggctcatgggagggcggcccgcgggcgctgcagggtatgtaaaatcaaaaaagttgttaagagccgcggtaaattattgttttagagggtgggaaggctgttgaatctatcaatgccctaggtgtggctcttcctccccttattatcttccaagggaagtgggttcaacagcagtagtttcctcttgaactcgagctatataagaagtggttttttacagcttctgcaacgggctggacgaataccaaaaatggcccactagtattgatacattcgaatgctcacgttcaattaagcaacaagagcttcttacatatttaaattttgagaatggatgaaggcaatatatagcccccgggtccctaatcattcgctttacctcataaaactgagttcaatactctggtggaggctcgcagcggttctgacgtgcaaatcgatcgtcaaatatgggcatgggggcgaaagactaatcgaaccttctggtggaggctcgcagcggttctgacgtgcaaatcgatcgtcaaatatgggcatgggggcgaaagactaatcgaacctgctagtagctggtttccgccgaagtttctcaattcgaccttgttgcagttctctgcaatgtacttgtgatatccgtttctgacattccggttctgattgaccttgactatccctcgtgccattcccacctggaccactgttagtaggggatttcctaggtaattcctttctagcttgatcaaccttgttatccggcgttggagctgtttccatttgacccgatttatggctcggatacgaagcttctctctgtcaccggctacgttttcacgtctccaacatctccctcctcagcaagtcagcggaggacgcacgcagggacgctcaccgctttctggcatggattctgacttagaggcgttcagccattatccagcagatggtagcttcgcggcactgcccggttgttctatcaaccagaggctgttcaccttggagacctgctgcggttatgagtacgacctggcgtgagaattattccttcccgcggggccagtatttcaaagagctcgcgaagctgattattctgaccaccacttcaaaaaaagtcatgtatatcggtcgcgcggtttggtgaaaagagtattctatctaataaaataaatatatatatataggaaggtaatatattagatatagaatatattactattagtattatatagatatccgactagggatcggacgatgttaaaaattgactcgttcggcaccttacgagaaatcaaagtgcttgggctccagggggcgtatggtcgcaaggctgaaacttaaagaaattgacggaagggcaccaccaggggtggagcctgcggcttaatttgactcctcgctgctttccgcccgccatgtcagctacgacccaagttgacccacaggcaagctgggggacatcggcaaaggccaggtgcgggtgaaggtggtggcccaaacaagaggcgcagagtcgcattggcttgcagcaactgccggcatcggaagacacgtaatctagtactaaaactagtttaagttctctatatagtttatattatatagatttaatttatatatatatattatattttaaaactatatttgaccagccttggctaccagctcgaaacacaggatacgatcctcagccaagaacatgtttttcttgaagatattcatgccatcaattcccttctggtgactcggccttcagcgaaagagcggctagagagactagggagagctctctcgcagccggattcgttccttcgtcgcctccagcaggaagtgacacttgaaccagtcttggttcacgcatcaccgctctccccgatttatcacatcgtacactatttcattggtcagttttacgaactgccaagccttcaacaccatttcgacactattgatttttaatttctgtatcaagggttgcatgtgacggcttaccaggttggttgggccccatcacaccgaatgtggtactctctacacgtccaacagctatgtgtgcttcgagtgagatttcgccagcccgttgttttctgcacattatccccgccgaaaaacgagggtttgaattggatcattggttgatgcttgagtgtggaacgcacgcgatgccgttttggtgtcaagaagtttcctgggctatatttaattagaaacccaaggatgaaaagaaaccagtaatttcctcatactcatacagcatcaggaatctgccctcggatatgacttcgtctttgtcatttgatgcagtgttctttgacagattaacacctttcggacaagcggtccaagtatgggggacgccgggggcaaagaaaccagtaatttcctcatactcatacagcatcaggaatctgccctcggatatgacttcgtctttgtcatttgattcagtgttctttgacagattaacacctttcggacaagcggtccaagtatgggggacgccgggggcgatggtgacgagggtccagtgcccctcgtgggcgctggtggccaaccccggcgaacgatagttacctggttgattctgccagtagtcatatgcttgcttgaatagcctcagactattcaaaaatacagtcaaaagagccctcgtaagagccccttgggtcataaggtcgaaaggcgcgatacagctgttcaaagatctcgtggctcttggatttattgaagactaactactgcgaaagcatttgccaaggatgttttcattaatcaggaacgaaagttaggggatcgaagacgagtggcgtgcaagagggtaaatgtgggccggtgtatttctgaagagtacccaggctcatgggagggcgtcccgcgggcgctggtaaaaggtttgcaaacctttaaaaaaaagactttctgtttcttaggccttggacataacccggctcgaccggacacgtgcacgagccgcttccaccagtttccaccggcttcatagctagatagaacctattcgttagttctcgacaacaacacaatagtctactcgctacattccctagcttgatttaataagatatatatttatatagtagaataataagttactttaaagaacctatagcttagattagtataaataaataatataaacttagtcctaatatttatattatctaactttctaagaactaataatataatatagaatttagatgttgtgccttatccagcctcaactggctaaggttcgtagttgcaaatggaggcgttcttccaattggtgaccgtatttccggagatgcttccatctgcggaagatggcccagtacaatgcggtcaggtttaagaaggaccagtgcgggatgttggtaaagtccgtgtgatagccgagcatgtggtaacatacctcaacggctgagagctgtctctcggaaaaaatccgattcgccaattctaattaattctagaatttagatttatagctatagtttatatatattagtaatagttagattaattcttatactaaactattatatataatttatactctgcacctcacatgacctacactttacataacctgcacctcacataacctgcaccccacaggctatctcaccgcctgtacctcacgctcagtagaccggccctccctgtatctagccactgtcctcgacttacagcgcttcccaccctctaaaacaatactaggcgggcgcctgatccggggcacacgaggcgcccggggcaatcccgccgaagcaacagtaggtatgttcacatgggtctaggcgggcgcctgatccggggcacacgaggcgcccggggcaatcccgccgaagcaacagtaggtatgttcacatggggttgggagttgtaaactcggtaatgatccctccgctggttcaccaacggagaccttgttacgacttttacttcctctaaattatggctggcgtggttgtaggtgctggggcctccttgttcctcgcccacttggcgagtttccaaagcgactctggggactcagatgctttctcgaccagacagttggacggtggccatggaagtcggaatccgctaaggactgtgtaacaactcaccaaccgaatgtactagccctgaaaatgcagacagttggacggtggccatggaagtcggaatccgctaaggactgtgtaacaactcaccaaccgaatgtactagccccgtcggttcaaggcgccctggaagatcgtggatgcgacggggctgagcgaggataacctgctcaccatccgtcgcaaccatccactcgtcaaccggtataacaaagcgattgctgcagcgccttaggctttcgccttcagcactcgcgcccctctctcataggtgcaccgacccacatttaccctcgttcacgcccctattgtttttttacttattcaatgaagcggggctggatttacgtccaacttctggttttaaggtccttcgcgggccggcccgggttgaagacattgtcaggtggggagtttggctggggcggcacatctgttaaaccataacgcaggtgtcctaaggctaataaccttatataactaacttttcttatttctaaataagtataattttagattaaactaaaataaactctaatatattaatactcatgcggtctttattgggcgtggtttgtcactttttggaattttcgaccagaaaatggaaaggtactacatagcacaccaagacactctcaccatgatcatgcaagcacccggccagttacagggcacctaccctactaaaacaacccacaacagtatatttacagacaagcaggtcatacgaacacgaagagggtatccgacgaggcagaggttcgaagacaggctcttcgcacgggagcgatacagctgtctaacgaagagggaaaagtcagacaagctcttcgcgcgagagcgatgcagctgtctttgaaacggaacttccctatggcttaggatcgactaacccacgtccaaccgctgttcacatggaacctttccccactgcggtccttcaagttctcattgaagtatttgctactaccaccaagatctgcactagaggccgttcaacccgggctcacgcgaccagtacacgcggtgaggcggaccggccagccaggcccaaggttcaactacgagctttttaaccacaacaactttaagatacgctattggagctggaattaccgcggctgctggcaccagacttgccctccaattgttcctcgttaagggatttaaatatactatacttatagagataaattaactaataatcttatataactaacttttcttatttctaaataaatataattttagattaaattaaaataaactctaatatactaatactaaatctaatctaataaaactaatatcctaatctaaatataactaaaaataatctaaagtttaaataattaatggaagccggtcaatattccggcacctggatgtgggttttgcgcggcaacgcaactgaacgcggagacgacggcgggggcgccaggcagagttctcttttcttcttaacggtctatcaccctgaaatcggtttgtccggagctagggtttaatggccggacgaagtgctgccagaaccataagtctgacaagatgcgaacgttcgattcattgctggtctgattaagatcgcgaaccagtattgtcatgagaagccgaaataactggtgctcaattggtttatcagcattcgataaacctaaagccccatgcaagtaaaatacttagacatgcatggcttaatctttgagacaagcatatgactactggcagaatcaaccaggtaactatcgttcgccgatacttagacatgcatggcttaatctttgagacaagcatatgactactggcagaatcaaccaggtaactatcgttcgcccggggcgggcgcctgatccggggcacacgaggcgcccggggcaatcccgccgaagcaacagtaggtatgttcacatgggtttgggagctaaataagatctataaaatgtattagtttaaatggtttagtattaatagaggaggaattctcttctaagttatagtagtattgagttctgtcgttatgctttcaatcatacgccggtatgtggctgccaggtccggtggcaaagatgcgagagcgttcaaaatcgccgcctcgtgacgacaccgagccaggctgtccaattgacagaatgcccacctaaacctagacacggcgtcagaacagacgacctaacctataccaggctaccctataaccagcctaccctagactaggtcttagatcttggataattccttcaactttaaagataagatatctaatatctatactcaactgatcagcttaagagcctctttcagataaaagtaggtcttataaagtgaggtgcatgtggtgaagtttggttcccggcgatgtgcatgtgctgtggttggatttgtggtggtgcatgcacgctgtggtggaatttacagccctatgcccttcactgggtgtagcggggaaacaggacttttactttgaaaaaattagagtgctccaggcaggcctttgctcgatagctatccatcttatgttaactgggcttgtagcctcccatccatcattcagacctcaggtgccctccaagacactttactagtggcactacatagcacacccagacactctcaccatgatcatgcaagcacccggccagttacagggcacctaccctactaaaacagtgcacctatgagagaggggcgcgagtgctgaaggcgaaagcctaaggcgctgcagcaaaccactcacagcgtctcggggcaactgtaacaagctggtccgatccgctgtgggaaatctcttcaactgtaccgtatcttgcagattcccactgagtggtgtaccgtagagtaatcgcctgctaagacgctaagccgaagcctattcttgtccatctgtacgtgcgggtggtatcaccgccagcacatgcacatcgccgggaaccaaacttcagcacatgcacctcactgggaatgccaccaaagcatattcacacacaccacacgccacctaacctatactttacataacctatactcaacataacctacactttacataacctatactcaacataactggttccttgttgttgttgttgttgttgttgttgttgttgttgttgttgttgttgttgttgttgttgttgttgttgttgctgttgtcaggcgtcgctttcccacgacttgtcggaacagtagccacgaaaaaggatacccttgttcaagcaaagtcccgtcgttgtgcagaggtcgcgctcgccggatttaccatctaggttgcagcagctggagtagacgccttcttgggtgatgccgagctcctggggaactgagagggggaaggtggattgccgtgcgcggcgtcggtggccctgccgctggtgctgtgttcggcgcgctctcacgcctggggaactgagagggggaaggtggattgccgtgcgcggcgtcggtggccctgccgctggtgctgtgttcggcgcgccctcacgagtgccattcagtaactaattctccagtgcccctcgtgggcgctggtggccaaccccggcgaacgatagttaccctggggaactgagagggggaaggtggattgccgtgcgcggcgtcggtggccctgccgctggtgctgtgttcggcgcgcgctcacgagcagcttattcgcaatgagatagatcgcgatccacatatacagaaccgcgagctactattcaaggtcaataacgtctgtaaggtcggagccttgcgagccttccttcgcgatgagaaccgccgtaagtggctacaacgcaaaagaccgcttctcctcaccccctggaaagtccctgagggagattgccgccatgttcaggtggattgactcagatgtgacaccgttcgcgtatgacagattgctctctaatcttgcgtcgtttgccccgttcaacccgggctcacgccctaggcttcgtcactgacctccacgtccgcctactcctcagggcatcgtttctaccctgacagctggctgggctatccctccttttatcatcctagctgcccaatatcatcttgagaactggtatcgggaatgcaatctgccgtacagactcgacggatggtgggttgcggcgggacttgtccgctaccaccctcttccgctgccatgatttgggctgataaatttcaagtgtattcgctcaaatatcaaacgaggcggttttggctgggttaacttcggcagtagagtagccttgttgttacgatctgctgagggtaagccgtccttcgcctcgatttccccaatacaggcggccctggcgtgggcgctggtggccaaccccggcgaacgatagttacctggttgattctgccagtagtcatatgcttgtctcaaagattaaaatcaaaatcaaggggacttttacccttttgttctactggagatttctgttctccatgagccccccttaggacaccttcgttatggtttaacagatgtgccgccccagccaaactccccacctgacaatgtcttcaacccgggtcggcccgcgaaggcttaacctgctaactagcccgtattgctttggcagtacgctggcttcttagagggactatcggctcaagccgatggaaggttgaggcaataacaggtctgtgatgcccttagatgttctgggccgcacgcgcgctacactgacggagccagcgagtactaaacccctacgcgtaatgaaagtgaacgtaggagagagcttcggcgcatctccgaccgatcctgatgttctcggatggagttgagtaagagcatacggggccggacccgaaagaaggtgaactatgcctgtatagggtgaagccagaggaaactctggtctgtagcgcttgcattagcggacctcgtgtccgctgtacgagaaccttagcacttagttagcgaacctcgtaaccactgtagcagctgcattagcggacctcgtgtccaacatccttggcaaatgctttcgcagtagttagtcttcaataaatccaagaatttcacctctgacaattgaatactgattcccccgactgtccctaaacatccttggcaaatgctttcgcagtagttagtcttcaataaatccaagaatttcacctctgacaattgaatactgatccccccgactgtccctattaatcattacggcggtcctagaaaccaacaaaatagaaccacacgtcctattttattattccccactgtcctcgacttacagcgcttcccaccctctaaaacaataatttaccgcggctcttaacaacttttttgattttacatctcttcctatcataccgaagcagaattcggtaagcgttggattgttcacccactaatagggaacgtgagctgggtttagacatagggtagctggttgtggtttctgcctacccggtaccccaacttcaaaccggtctcccgccttccacgcggatcggagggattctgaccaccacttcaaaaaaagtcatgtatatcggtcgcgcggtttggtggccgtgagtcgatttttttgatttcccgagggtcgacgcccactatgaatcacccgccagcgaagccgaagccgtctagcctgtccaagtgaccactcagtgggaatcgagggtcgacgcccactatgaatcacccgccagcgaagccgaagccgtctagcctgtccaagtgaccactcagtgggaagctgcaagatacggtacagttgaagagatttcccacagcggatcggacatagaaggataaatagtaaaaagtatttaataaaattaaagattaaatacttttagaacctatactatagatatttaaccctataaaggaagtagaacttaaaactaatattttagactttataattagtatataactcagctaaagagataataaaggaatactataccctgtagtattcttcttaaagaaaggggtctttggaacccacagttgtggtagctcagtagcctcttcaacaggtgatggcgtccgcggccttatatctagccatgacaagacgctttttgggtcaaatggaataaggcctgcacctctaaaagcgccctggatagtttgttccgtcattgcagtttcggcagttgccatattgccaaaacagctcttgaataaccgagcgttagcttctgtaaatactaaccagaaaaaaagggggtaagaagctggaaagcaaggcaaaaaggtataaaaaacaacacacctctacaaggcatagagtcgctatacgtttgatgagggtcgtgatcccggttgattgtgggtcctcaaggctcctttgtattgattgaatggactcaactttgtgaaacaaaacagttgaatcatagggactcaggtgtctgacctactgcgccgcatcgcagcaagcgaagcctgagggagatggaatgatctcctagtcgcgtaaacgatgacgcgcgtcgttgacagactacatttaagtcggtgagggcggaggattcaaagcttaggagatcgaaggatcaaaaagcgacgtcgctatgaacgcttggccgccacaagccagttatccctgtggtaacttttctggcagctctagcttctacagcacacttctagtaccgtagagtaatcgcctgctaagacgctaagccgaagcctattcttgtccatctgtacgttcgggtggtatcaccgctttctggcatggattctgacttagaggcgttcagccattatccagcagatggtagcttcgcgggccagaactctggcgtccttgtaatccatctcccaaaccccctacgcagccagccaccagggccgcctgtattggggaactcgaggcgaaggacggcttaccctcagcagatcgtaacaacaaggctactctactgcttacaggaccgtttcgcacagcccatactcgtcagtgtctcaggatgatctgctccaagcttggtcttacgagtttccatcacctgcacaaaaagcttctcagcctcctcccaccggccttgattcctatatgttgatgcaagattggccatactcactcacggccaccaaaccgcgcgaccgatatacatgactttttttgaagtggtggtcagaataatcagcttcgcgagctcgttgaaatactggccttctcacttccctccgatccgcgtggaaggcgggagaccggtttgagtgccatgttcgatgcaatggcaatttgccaatctggtaaggcaaaggctccttctgttcgaagcaataacgaaaagaaagaaaggaaacaaaaaaactgatgctggcctgggcaggcagagtgcaccgcggagaaccacggatgatccacctgcccaagtctggtcatgaacgcttccctttcaacaatttcacgtactttttaaccctcttttcaaagtgcttttcgcgtagtcgggggcgttgagggccgggtttgaaaggtgtattgaggtgaaaccacgtatggattcaacaagggaatcgccatgttaactggccacattccggacaccagcagagctattattaggttatcgggcttatctagcccagataagggtctagaaaatccgggaaaaatcctaggagattctcaggtggattgacagaagcaatggatggagtgagtggcaggcgggtcgagatttgggggttgaaggggagtaatcattggggggaaggactgggaggttagcgcaagggtgggtttcactccttgcggtatggctagctggctggcattaacacaaaacatgaattttgcggaaaatcaaaagtggcccgggaaccgaccgtggcgtgcacgagggtaaatgtgggtcggtgcacctaggagagaggggcgcgagtgctgaaggcgaaagcctaaggcgctgcagcaaaccactcacagcgtctcgggtcaactgtaaagcccagcacctctgctgggtctggtgcgctctcgacgtcccttgaaaatccgcgggaaggaataattctcacgccaggtagcccagcacctctgctgggtctggtgcgctctcgacgtcccttgaaaatccgcgggaaggaataattctcacgccagggcgtactcataaccgcagcaggtctccaaggtgaacagcctctggttgatagaacaatgtagataagggaagtcggcaaatccacagaacccatccagcgccggcgagagcagagctctccccagaccaggcatcctcagtacgacgtaccgcacgcggccgcatcactccaccaactaagaacggccatgcaccaccacccacaaaatcaagaaagagctctcaatctgtcaatcctcattgttggacggtggccatggaagtcggaatccgctaaggactgtgtaacaactcaccaaccgaatgtactagccctgaaaatggatggcgcttcgttccatccgggtcatgctgttcaacgtaggtgaaagctgcctcggctagccactgtttgaacggcttattgactgttgtatcgagaggttgaagaaggcttgtacaaccgggcgggatcagggctgttgtaatcttacgagatcgtaggtcttgagtgtatcaccccgctaaaattccaaccccagcgcacccaacccactacataatcaaccacagcgcacccacaccaccaccaatccaaccacagcgaatgcacgccactgtaaattccaccacagcgtgcatgcaccaccacaaatccaaccacagcacatcacccaatcggcacgctgtcatggcggttacagctcattttcttgaccgcgtaggcaagcaccagtcgcgtctactagcacttcgacgccagctcgggtttagaggttcgtggcttccgtacgcgctgcctcttcctcctcaattcgtcaagcccaccttgtacgtcttttatctgcgtaagtgagcagaaaatctcattcttatctggtttaacggctctacgcttcttatgacttaggcgttcattcagggccttttgggcctctaattcccgatctttcaagaccagtcattagcggtcctcgtgtccgctgtagcgcttgcattagcggacctcgtgtccgctgtacgagaaccttagcacttagttagttttacccttttgttctactggagatttctgttctccatgagccccccttaggacacctgcgttatggtttaacagatgttccgccccagccaaactccccacctgacaatgtcttcaacccgggtcggcccgcgaaggaccttaaaaccagaagttggaaaacaagaattaagtttcctaggcgggcgcctgatccggggcacacgaggcgcccggggcaatcccgccgaagcaacagtagaaacaagaattaagtttcctaggcgggcgcctgatccggggcacacgaggcgcccggggcaatcccgccgaagcaacaggaggtatgttcacatgggtttgggagttgtaaactcggtaatgatccctccgctggttcaccaacggagaccttgttacgcttgcagacacatagtctagggagaatgtaatactttaagtttattttaaggctgtgcatatttgatagccagaagtatgcatataattttatttcaagcctatgtaatactatccatgattttaatgttaatctttggaggtatcaagatgcgaaggtaagaaaagaaggaatatatcattctggaagcatttgatcataaattcatcggttgtatgacttccgtggccatcaaggataagcaacctaggtctcttacacctcacataacctgcaccccacaggctatctcaccgcctgtagctcacgctcagtagaccggccctccctgtatctacccactgtcctcgacttacagcgcttcccaccctctaaaacaataatttaccgcggctcttaacaacttttttgattttaggggaatgtgtataagtatgggtgctccctccagtgtaaatcatgaatagaacaagtaatgcaatcactcatttcaacatgctccgtcacattaaccgttgagcttggcttttggtaagtgtccaagtagatggaccccatgactagcgagtgggatcagcacttacgggaacagttttaacaagtgaatcaggaagttgagagatatggatgatggcgacgatgacggcgaggaggcggaggcttgcctgaccaattcggaggggaggcgggttctggcagccctggaagatatcatgagaggccggccgtacgttgttgcgagtgtcctccacccggtccagcagctgccgtgcctgtagccgccggatgaagtcctggaaccccttcgtgatcgctgactcgggcgtcacgaacaccagactggcgatccggctcggcccctggctctgccagatatgttatagcctgaaggcacaactaacgcctccagggcacagccagcctccagagggccctttatagccagatgacagatgacgaattaagtaacggactctgctgacttagccaatagatatctccacttccaaactcagctcgtaaaatgtgaccactcaagatccttgcgcatttgggtaaatgaaaaccaaagtgatgaaagaattgaagaagatatcatgagagtactgatatcttttttcttttcccttttgtgattatcattccgtagacgccgtaattaggtccgaacgatcgcacaggcgaaagagtactctaccaagttgcttatgtatactgttgtgggttgttttagtagggtaggtgccctgtaactggccgggtgcttgcatgatcatggggagagtgtctgggtgtgctatgtagtacctttccattttctggtcgaaactcttgaggcagagaactgtgactctcctcacctgtctttcgtcatcgtgtttgtcacctggttggtggcagtctcggggtccggtacattgtggctgggatagagggatgtctagtcgatctatagaataccctataatatttatactaaagaaaaataataaactctatttagttattaattactaatagctaaataaaattatatataaaggtcaaccttggaaagttgggggtttaacggcaggggctcgtcgctctccgatgcggaatatcactacttcgcagaggcggccacgacgggtccgccactagatttaggggccggccgtccctcgcgggctttggccgatccccaacaccacgccctaaggtcaaccttggaaagttgggggtttaacggcaggggctcgtcgctctccgatgcggaatatcactacttcgcagagggggccacgacgggtccgccactagagtttcacagaggctaggcatccaaccgtacggggctctcaccctctatggcgtcccgttccagggaactcggaaggcacctaccactttcaaggttcttgcgccaattgtctctatcacacgtacggtgattgcgagtatcacttcctcgactacaagcctaagaaccctcgtgaaggtcctgtcactaaccctcttcacggtcataatacagtcgaatctcctatccgtactgaagaggttctttcccctgagacagccccccgtcaccactttcaaggttcttgcgccaattgtctctatcacacgtacggtgattgcgagtatcacttcctcgactacaagcccaagaaccctcgtgaaggtcctgtcaccaaccctcttcacggtcataatacagtcgaatctcctatccgtactgaagaggttgatcgccgtcagactaccaaggtacacagcaaagttgaagttgggtcctggaaacgcctggatgatagcgaggccaatcaggaagtcacgcgcgctgacccagccttcgtcgacaatatactcgcggagcagcggaatcacatccctgttggtttcttttcctccgcttattgatatgcttaagttcagcgggtattcctacctgatctgaggtcaacctgggaaagttgggggtttaacggcaggggctcgtcgctctccgatgcggaatatcactacttcgcagaggaggccacgacgtcaaaaaaagtcatgtatatcggtcgcgcggtttggtggccgtgagtcgatttttttgatttcccatacaaatgaatttttcaaaaaaagtcatgtatatcggtcgcgcggtttggtggccgtgagtcgatttttttgatttcccatacaaatgaatttggcggaaaatcaaaacttcggaagcggcgatttggctcggcgtcgcaaattcgtggcccatgaagagccaatgggtggtacccagcgcggtgatggcgtgccggatcaggggctcactctcaccacaaaaggtgttagtacatccagacagttggacggtggccatggaagtcggaatccgctaaggactgtgtaacaactcgtgcatgcacgctgtggtggaatttacagtggcgtgcattcgctgtggttggatttgtggtggtgtgggtgcgctgtgggtgattatgtagtgggttgggtgcgctggggttggaattttagcggggtgatacacgctatggctgacttccagttgctttccatatcaagataaacctctcctagcatactaagaattagaataacaaaggtagtttgaagtattgccaagaccacctatactgaccatttgcagtttttcaactttcaaggaaatcagtagtagacaagatagtcacgtagctgtccacctgacctgagatcgattagactcgccgccacagcaattggttctgcagccgtagctgcagttgggggaagaggggacgatcgctctaatgagccaaagaaaaaagagctaccatatatcgtttgacttgtgaagaaccattgaatagtggccacctgacctgagatcgattagactcgccgccacagcaattggttctgcagccgtagctgcagttgggggaagaggggggacgatcgctctaaaactgcgaatggctcattatataagttatcgtttatttgatagtaccttactacttggataaccgtggtaattctagagataatacatgcttaaaatcccgacttcggaagggatgtatttattagattaaaaaccaatgcccttcggggctctctggtctagactggaagccctacgctacctaggtacaacgcgatcgcccgcgcaagacaaatcttaagcatcaatggcatcccccaaggttggataggtcctgaatgatcaagacaccagcggcagggccaccgacgccgcgcacggcaatccaccttccccctctcagttccccagggcatccttccaccacaccatgacttttgtaaacccgccatcccatctcttctaagctaccctgaaggctatatcgcctaagatactggagaaggagctgtgcgggatgtaaagatagactggctaccctgcagccgcttcccgagagacagaccgggcgccagaactctggcgtcccgtggttctccgcggtgcactctgcctgcccaggccagcatcagttcgccccgggggataaaggctttgggaatgtggcgccctcgggagtgttatagcccactgtgtaataccctggggtggactgaggttcgcgctctgcaaggatgctggcgtaattcgacttatagcaggctttctatccatacgcgtatggattagtcgtatggaatactttgtatggaatacagttaatccacactccatacagcctgcgagtattccatacgtatggaatatcacggaagatagttgatccatatgaaacttcgttgatcagaacaaggtagactaataattactagttgtctagttgtatatataatctagtatatcagccaattcattctagtcctcgcacaattgtaagtatttttcgaggctttctagcattcgtaacttagaaccaatcatgatccagcgtatctcggatttcgagcagatgccgagtttgcccgctgatcctttcaacaacggatctcttggttctggcatcgatgaagaacgcagcgaaatgcgataagtaatgtgaattgcagaattaagtgaatcatcgaatctttgaacgcacattgcgcccgccagtattctggcgggcatgcctgtctgagcgtcatttcaacgtgttggggatcggccaaagcccgcgagggacggccggcccctaaatctagtggcggacccgtcgtggcctcctctgcgcagtagtgatattccgcatcggagagcgacgagcccctgccgttaaacccccaactttccaaggttgacctcagatcaggatattttttaagaatataattagcagtctatatctgaatctttaatactataagataaagttaaatattatactttcagcctgggtataggtattaatactttaaaaactctaataataggagctatttatacagctagataccagcttgttacagttgacccgagacgctgtgagtggtttgctgcagcgccttaggctttcgccttcagcactcgcgccccccagcttgttacagttgacccgagacgctgtgagtggtttgctgcagcgccttaggctttcgccttcagcactcgcgccgctctctcataggtgcaccgacccacatttaccctcgtgcacgccacggtcggttcccgggccacttttgattttccgcaggaagtttgaggcaataacaggtctgtgatgcccttagatgttctgggccgcacgcgcgctacactgacggagccagcggggttgaaagggaagcgttcatgaccagacttgggcaggttgatcatccgtggttctccgcggtgcactctgcctgcccagcccagcatcagtcacgctcatcaagagatctcttgccactccccttcttagcacccttggcagcagccttgacaacagacataccagcaccacgctcatcactttcatctagaaattagaacttcctctttacaacataataattttctaacctaaaatgaagaatacttcgtatgaagtaagtattatccttgcaattcaagctcttaatcaagactctaaattaagcattagagccgcagcaaagatctatcaagtcgtattaatcttattaggttaggtttagtattagtatattagagtttattttagtttaatctaaaattatacttatttaggaataagttccatcggcttgagccgatagtccctctaagaagccagcgtactgccaaagcaatacgggctagttagcaggttaagggctcgttcgttatcgcaattaagcagacaaatcactccaccaactaagaacggccatgcaccaccacccacaaaatcaagtggaagaagaagcggtcttttgcgttgtagccacttacggcggttctcatcgcgaaggaaggctcgcaaggctccgaccgtacagacgttattgaccttgaatagtagctcgcggttctgtatatgtggatcgcgatctatctcattgcgaataagctgtacccgcgcttggtcgaatggcttcgctttgacattcagagcactgggcagaaatcacattgcgtcaacaccactttctgccatagggaagttccgtttcaaaggcgcactttgcgccgtgtggcgaaagggaagccggtcaatattccggcacctggaggtgggttttgcgcggcaacgcaactgaacgcggagacgacggcgggggccccaggcagagttctcttttcttcttaacggattgccctagtaacggcgagtgaagcggcaacagctcaaatttgaaatctggcgcaagcccgagttgtaatttgtagaggatgtcttccgcgtgccggggcctaacttcatgtggtctcttgacggctatgagaagttgaagaagttcggatttcaaatatatacttgtattgacgcgtactcaaggtgtataatttggttctatattggccgatcagcaacaacctcgatgagcacattgaaccatctgcttccagtcaagacaccattggtaggccaccttgtcataccgttgaggcagacccattgccttccgatactgttggttagtcttgatactgccacgaggctgcgccttgtaccaagcttctcttgttgcaacatatctctgatagatagccttcggtagtagcgacgggcggtgtgtacaaagggcagggacgtaatcaacgcaagctgatgacttgcgcttactagggatgcctcgttgaagagcaataattgcaatgctctatccccagcacgacggagtttaacaagattacccaggcctttcggccatgtgcaacgtcctatcttcggcggctgaagcgacgttcgcttttatgagacggggtgtttggtgtttaatataagtaggttaggaagagtaagtaggtgagattcttgcaatctggtttcagtattgtgtgtcgagtcggcctgtggccattgcaattgatatgcttaagttcagcgggtattcctacctgatctgaggtcaaccttggaaagttgggggtttaacggcaggggcccgtcgctctccgatgcttaccgcggctcttaacaacttttttgattttacataccctgcagcgcccgcgggacgccctcccatgagcctgggtacccttcagaaatacaccggcccacatttaccctcttgcacgccacggtcagttcccgggccagttttgattttccgcaaaagcgcaaagtgcgcctttgaaacggaacttccctatggcttaggatcgactaacccacgtccaaccgctgttcacatggaccctttccccacttcggtccttcaagttctcattgaagtatttgctactaccaccaagatctgcactagaggccgttcaattagttttaccctactgatgacctcgccgcaatggtaattgagcttagtacgagaggaaccgctcattcagataattggtctaacatcagagccatgaaccctcgaaacctcaaagcccacgtagaccgggcgattgaacaaagcggcaatgagcacattaagcatatcagagtagcctggtgattcatgataacttctcgaatcgcatggccttgcgccggcgatggttcattcaaatttcttccctatcaactttctatgtttgggtattggccaaacatggttgcaacgggtaacggagggttagggctcgaccccggagaaggagcctgagaaacggacaccgccatggttgaagctgtgcgctgagcactcctcttggggcgcccaagccgcaccggccctagtggtcttggggtggtggaaggatgccctggggaactgagagggggaaggtggattgccgtgcgcggcgtcggtggccctgccgctggtgttataaaatcgagatacatttgtaaaaattacgtcgtaatgtattggctttatagcctaaaataaaaataaaaaaaaaatgcgtttacttaaaagtcatccttttttaagattatttaatgcttatttaatagatcactgacgcctttgaaacactgacgcctttgaaacactgacgcctttgaaacactgacgcctttgaaacactgacgcctttgaaacactgacgctgaaaatccgcgggaaggaataattctcacgccaggtcgtactcataaccgcagcaggtctccaaggtgaacagcctctcgttgatcaagcgaagaggtgttggaagacctcatcgacaagatgcagcagaatacgctcagtcttattacagacaagcagccgtactataaaaggtacgattcgagaaccgattgaaccggagcgtcgatggaaaatgctttaatcagccaaccttatttgtcgcggacacctcaattgccatccttactgatgtagtgatactgttagcgccgatacccttgacctggtcgatgcgattaccctttaagaagaagatcagcgccataacggcaacccctgaaaactacggttgtggttagcaatggcagcaatagccgcagcccctgagaaatgcagtggagttgtgccaaattgggggctgacataatccgcacgcctacgcgtgcagaagtggagcggcgcctaggcgtgtcctgttagcgatcacaaccactagcctctagcgattgcagccactggccacaatcgctaataaccccctgctaacgctagctaatagcgattgagatcgctatctgatagcgattacgatcactaaccaatagcggctgcagccactgtgggtcagtggcttttaaaatataatatatatatataaattaaatctatataatataaactatatagagaacttaaactagttttaatattagaatatattatatatagtattaatagataatatactaatttaaattaatttaaactaaaataactctttaaattaaataaatatttatttattttaattagtattattagatagaaaagaattaaatagaatagaattattagaaagtttattaaatagaaaaattaaattaaataaaccaagtggctaccgggtattctaaaaggtttaaaagagatcaataatgagacttcgagaaaaatcaaaccaccgtttcccctatatgtattatatatgaagcaatacaacgagggatatcaaacaggcagggtgatagtggggttatgcccagggctattctaccgaggagattgattccgatgaattcctttccaagccaggcggagccttggcaggaggatttagtcgagcgtgtacccacccaaagaaaaggtctgttgttcaatgccagttgttgctgttgttgctgttgttgctgttgttgctgttgttgctgttgttgctgctgctgtggttgtacgcggccactgtctgcttcccaagaccctgctcggcgtctcaatctgtcgatgcatagctccaccacgttaacctcggcgcagcgttgttgacggtgccaccgaggtaggcctcggcggtctcacgcatcttggtgaggatcatcgaggagatctcctcgggagtgaactgcttggactctcccttgaactcgacctcgacgacgggcttgccgcccttctacgacgggtccgccactagatttaggggccggccgtccctcgcgggctttggccgatccccaacaccacgccctaggggaatgagggttgaaatgacgctcagacaggcatgcccgccagaatactggcgggcgcaatgtgcgttcaaagattcgatgaggtgcgaactccgtcattgtcttgggcgcctctattcatatcgtcaggcgtccgaggccgttgttgaggcaacaatgaagtggcctgaagttttcaggagcttcaaagtcaactacattcaatctgcaaagcaaaagaaggctgcgccgcccaagtcagcgagattaacagacgtactgcactatgcttttcctgaagacgacctagaagagttccaagatgatattgaggcttatactattaagataatagttagatttattattattattattatctttatagttatatatatataaatagagctgttatcaaataaacgataacttatataatgagccattcgcagtttcgccgtataattgcttatacttagacatgcatggctgaatctttgagacaagcatatgactactggcagaatcaaccaggtaactatcgttcgccggggttggccaccagcgcccatcaatctattaattcccgaggtgaggcaatcccgccatttatcatcgttgcggggcaatatcatctctccaactggtatgaagacagcgcgctaccgaaggattgggtcatctcccaaacaatcgtcgacaagtacgctatcaataccggataggcatcgttggatccatttattgtactcctctccctgcctcgtcactatggccgcctcaaccgcgtcccaggtcgtttcacagcccagaagagcagatagatgggttatggcgcgaatgtgcaaacaatcgtcgacaagtacgctatcaataccggataggcatcgttggatccatttattgtactcctctccctgcctcctcactatggccgcctcaaccgcgtcccagggcgtgagcccgggttgaacggcctctagtgcagatcttggtggtagtagcaaatacttcaatgagaacttgaaggagcgaagtggggaaaggttccatgtgaacagcggttggacgtgggttagtcgatcctaagccatagggaagttccgtttcatctgacttagaggcgttcagccattatccagcagatggtagcttcgcggcactgcccggtcggacagccgcaaaaaccaactggacgtctgtcggcactttcagtcgtccttcagcaactacatcttcaaaatcctgaacaacacacttcagttttggaaaagcccttgcgagttcgatagaggctgggccatgtgcccccaaggaaggcagcaggcgcgcaaattacccaatcccgactcggggaggtagtgacaataaatactgatacagggttctttttttcagagctcctatatgtgcccgcagtatctcaatacaacgaatgtcgctccagttatgaaagatagctctgaaaagaaaaacatccgcgcctgtggctttctgtgttttaaacatatcgtgtgcaattgtcagaggtgaaattcttggatttattgaagactaactactgcgaaagcatttgccaaggatgttttcattaataaggaacgaaagttaggggatcgaagacgatcagataccgtcgtagtcttaaccataaactatgccgactagggatcggatccaacacagcctgagccttcgcaatttcatctcccttcctcttaataatcatattgcgagcctctgagaccttcaggactcctcctgactgtagcctctagttctttgcattcctcttgtagttatatatcttctatagtattagatagtattataatattccttattggtatatctgggccgcacgcgcgctacactgacggagccagcgagtactcccttggccgaaaggcctgggtaatcttgttaaactccggcgtgctggggatagagcattgcaattattgctcttcaacgaggaatccctagtaagcgcaagtcatcagcttgcgttgaaacagggattgccctagtaacggcgagtgaagcggcaacagctcaaatttgaaatctggcgcaagcccgagttgtaatttgaacagggattgccctagtaacggcgagtgaagcggcaacagctcaaatttgaaatctggcgcaagcccgagttgtaattggtagaggatgtttctggcgacgtgccttccgagttccctggaacgggacgccatagagggtgagagccccgtacggttggttgacccgagacgctgtgagtggtttgctgcagcgccttaggctttcgccttcagcactcgcgcccctctctcataggtgcaccgagaccttaacctgctaactagcccgtattgctttggcagtacgctggcttcttagagggactatcggctcaagccgagggaagtttgaggcaataacaggtctgtgatgcccttagatgttctgggccgcacgcgcgctacactgacggagccagcgacgtagccggtgacagagagaagcttcgtatccgagccataaatcggtaacatcgccgtgcatgtcagaaaaaaagcgtccccaaggcacgaatagggccagatggagaacagagttactggacggaaatgtgagaacaagcctcggggttagcagtgtagggccgcctgtattggggaaatcgaggcgaaggacggcttaccctcagcagatcgtaacaacaaggctactctactgcgtacaggaccgtttcgcacagctaagtcgtctgcaaaggatttgaccccgctcgttttaaaattacaatacgcgaaatacccacccacaaaatcaagaaagagctctcaatctgtcaatcctcattgtgtctggacctggtgagtttccccgtgttgagtcaccacccacaaaatcaagaaagagctctcaatctgtcaatcctcattgtgtctggacctggtgagtttccccgtgttgaggtcgtagcacagatcttctcctgcagttgacgtcgctaaccctcaaatccgtactcagagggctaggcacagactgcgtcagaggttttatgtctagcgccttccccttagaaaaggagcagccgaagtggcctgtgcgatcgccagctcgcaaaatcgaagcatggaataataaaataggacgtgtggttctattttgttggtttctaggaccgccgtaatgattaatagggacagtctggggcatcagtattcaattgtcagaggtgaaaaacatcctctacaaattacaactcgggcttgcgccagatttcaaatttgagctgttgccgcttcactcgccgttactagtgcaatccctgttggtttcttttcctccgcttattgatatgcttaagttcagcgggtattcctacctgatctgaggtcaagcggcccagaacatctaagggcatcacagacctgttattgcctcaaacttccatcggcttgagccgatagtccctctaataagccagttaagcatatcagagtagcctcgactaaccagctcaagagcggcgatttgagcatcaagacagccaccaccgaggacatagaggtattaagacagtttgctgaagactgggaacaccgacttggcaccaatgccacggtcagaattccaacttacggtatcctcgggcaagcacgtcgtccatatcggcgttgggcgtggtttgtgcgccaccctgtggacctgtctcaatctcatctagcatccggagaatcatattttcacttctttttgattcatattgtgggtctctccactcacacatcctaatcggggtacatatctaataatagtcttcaaatatgtatctacaaggattatcggttctacaccaggacttggcatggtggcttgactgcatagcagattggtagttcgggattttaagtttagccagcggccatccatccacagaacccatccagcgccggcgagagcagagctctccccagaccaggcatccttacctcgccctcagggtagaaacgatgccctgaggagtaggcggacgtggaggtcagtgacgaagcctagggcgtgagcgcgggttgaacggcctctagtgcagatcttggtggtagtagcaaatacttcaatgagaacttgaaggaccgaagtggggaatcataaccacgagccaagcacaaatctatctgcacatccagttcaccgtcagctatcccatgctgataggtcaactatcaacaatcataaccacgagccaagcacaaatctatctgcacatccagttcaccgtcagctatcccatgctgataggtcaactattaacaaccttgcgaatgctggggtagcgccgaaagagatcaggtcctacctacgtcagaacacacagtctcgtgctacccctacagcaggtaacatggaaaaaggagattaagaacaagagtgcagaataaggtggatgctagtgttctacagacagccgacctatggtgccggggctggatttacgtccaacttctggttttaaggtccttcgcgggccgacccgggttgaagacattgtcaggtggggcgtttggctggggcggcacatctgttaaaccataacgcaggtgtcctaaggggggctcatggagaacagaaatctccagtaaagcttgtacgctttcctcttgaaccagctaacagtaagtagcctacctagcttcctagcctggtggaattccttcatgagagcttctttataaactatagttttagaatataatatatatatataaattaaatctatataatataaactatatagagaatttaaactatgcttctgtcaatccactttctctcgtccttcccgccctggtctccatccattcatctcttcctcgacctgtttttgtattatatctccatcaccaatgattagtttttacaaataaataaaaactttcaacaacggatctcttggttctggcatcgatgaagaacgcagcgaaatgcgagacatttcccccccttaccagcacgcttagcctataggcatatcttagtaggatatattaaatagggtaatcatgaatgcttacacgctggtgccctgaggagtaggcggacgtggaggtcagtgacgaagcctagggcgtgagcccgggttgaacggcctctagtgcaggtcttgtctcaaactttaaatatgtaagaagctcttgttgcttaattgaacgtgagcattcgaatgtatcaatactagtgggccagttttggtaagcagaactggcgatgcgggatgaaccgaacgcgaggttaaggtgccagagtagacgctcatcagacaccaatgctgaagcactcaagtatatcggatcatgcattaataatattggaggggaaggtcttaacgtgcctaacgcttatcggtggctcgccccgtacggttggatgcctagcctctgtgaaactccttcgacgagtcgagtagtttgggaatgctgctctaaatggggggtatacgtcttctaaagtcgatttttttgatttcccatacaaatgaattttgcggaaaatcaaaagtggcccgggaaccgaccgtggcgtgcacgggggtaaatgtgggtcggtgcacctatgagagaggggcgtagcctctgtgaaactccttcgacgagtcgagtagtttgggaatgctgctctaaatgggaggtatacgtcttctaaagcgaaatctgtggtgatatgaagagatctgtatccagcaccttcaagtggcctcattgcgtcaattctaggcaggaagtctccaagcttatgaagtaatgaaggccgaagtattgtgttttcttttgaatttgagatggtccaacatgcccgatacggaggagattgccaagaattgcgaatttcagctccagtgcaaaacgagtacattgtgaccccgctcgccatgtattttaaattgtagtatctctatttcgaattttgcggaaaatcaaaagtggcccgggaaccgaccgtggcgtgcacgagggtaaatgtgggtcggtgcacctatgagggaggggcgcgagtacattaacaggccacaagccggaccccttccagcccgagcgaatattcgtatctgttagaccgatcaatcgagcctttgtactgcctttggctttggcttggatgctgcatttgacctgtgtggtgcctttggctttggcttttgtgttgcctttgacctatgtggtgcctttgcctttggcttttgtgcggcttgggcgccccaagaggagtgctcagcgcacagcttcaaccatggcggtgtccgctgcacgtggcgatctcccgttgctcccgaattctgcttcggtatgataggaagagccgacatcgaaggatcaaaaagcgacgtcgctatgaacgcttggccgccacccgaattctgcttcggtatgataggaagagccgacatcgaaggatcaaaaagcgacgtcgctatgaacgcttggccgcccgaccttaacctgctaactagcccgtattgctttggcagtacgctggcttcttagagggactatcggctcaagccgatggaacagaacatctaagggcatcacagacctgttattgcctcaaacttccatcggcttgagccgatagtccctctaagaagcccgcgtactgcccagaacatctaagggcatcacagacctgttattgcctcaaacttccatcggcttgagccgatagtccctctaagaagccggccgaatgtactcacttatttcataagtgggctttgatacctattggatttagcatttaatgaacttaacctacgatgaatgttaatttcgcatcgcacttcattcaccccaagccagccaataatttctatctaagatttagtaataaatactgtggagactgagggttttctcggtacctgtccacaaatccaaccacagcgaatgcacgccactgtaaattccaccacagcgtgcatgcaccaccacaaatccaaccacagcccacaaatccaaccacagcgaatgcacgccactgtaaattccaccacagcgtgcatgcaccaccacaaatccaaccacaccacatgcacatcgccgggaaccaaacgaacccatccagcgccggcgagagcagagctctccccagaccaggcatcctcagtacgacgtaccgcacgcggccgcttgcgtgagggtcgacgcccactatgaatcacccgctacgagcaaaatggctatatattcggaatcagaaattaattctgcgattaatgatatacttgccggcttatctgtacgctttgctgcaaagaaatgggcaattcctcgtacaacgcttagacgacgattggaagatggcttcacacgagcacaagcgcagcgcgccgaacacagcaccagcggcagggccaccgacgccgcgcacggcaatccaccttccccctctcagttccccagggccgctggcttcttagagggactatcggctcaagccgatggaagtttgaggcaataacaggtctgtgatgcccttagatgtgctgggccgcacgcgcgctacactgacggagccagcgagtactcccttggccgaaaggcctgggtaatcttgttaaactcgggcctgcatcgtattttccgccgtgattttcgattcggctcgggccatttgaagcgcgtcgtgtatggtaccgaggtcaggaatgttgtggattttgttaacgaaagatagtgcgctcatagccatcatcttagccatgtcattggggacgggttggtggcgggtcgagatttgggggttgaaggggagtaatcattggggaaggactgggaggttagcgcaagggtgggtttcactccttgcggtatggctagctggctggcattaacacaaaactcgtcattcgtccagcccgttgcagaagctgtaaaaaaccacttcttatatagctcgagttcaagaggaaaccactgctattgaacccacttcccttggaagataataaggggaggaagagccacacctagggcattgatagattcaacagcagttactgcgtactgccaaagcaatacgggctagttagcaggttaaggtctcgttcgttatcgcaattaagcagacaaatcactcccccaactaagaacggccatgcaccaccacccacaaaatcaagaaagagctctcaatctgtcaatcctcattgtgtctggagacgaattcggccaggcgccgctatcgattgcgtcagaaaacgggcatgaggcagtggtcaggctattacttgcaacaagcgttatcaatccagactcccagactagctacggtcggacaccgttgtggtgggccgcgaggaacgggaacgatgcggtggtcgcgatactacttgcaacgactgctggactactaataaggttggtctggattggattaagtactttaattcctatacagctcctcgtacgaagggggtatttcgaatgctaatccttgatagctatagcggccgcgtgcggtacgtcgtactgaggatgcctggtctggggagagctctgctctcgccggcgctggatgggttctggggatggatggccgctggctaaacttaccactgagcaacgggagatcgccacgtgcagcggacaccgccatggttgaagcggtagtagcaaatacttcaatgagaacttgaaggaccgaagtggggaaaggttccatgtgaacagcggttggacgtggggtagtcgatcctaagccatagggaagttccgtttcaaaggcgcactttgcgccgtgtggcgaaagggaagccggtcaatacccgagggagccacattcccaaagcctttatcccccggggcgaactgatgctggcctgggcaggcagagtgcaccgcggagcccgagggagccacattcccaaagcctttatcccccggggcgaactgatgctggcctgggcaggcagagtgcaccgcggcgaaccacggatgatcaacctgcccactttacataacctatactcaacataacctacactttacataacctgcacctcacatgacctacactttacataacctgcccctcacataacctgcaccccacaggctatctcaccgcctgtagctcacgctcagtagaccggccctccctgtatctagcttgatacgaagaagatcaattcgcttgcctcgtaacatcttaatttccgggttccgtttcaaaaagccctctatccagtactttcccagacgcattggagggtctgacggagggagcaaagttgaggctatcgcaataacctggctatgcgacggagccgggcctttccctctgtggaaccctatgcccttcactgggtgtagcggggaaacaggacttttactttgaaaaaattagaaaatcaacccaaggacccaattctatttcgcaccatggccttgacgactgaatcagcttcgacgtatgccgttggcaagactatagataacgactttgacttagctctgacctataatgatgggttcacggatccctttacaaatgccgaccgtatgatggtggatccccgcctagcaatgccttctaatactaagactagtttaagttctctatatagtttatattatatagatttaatttatatatatatattatattctgaatcttatcgtacctgatgtttacttgtgcgcagagctatcaacgtccctgtttcacgggatactcgcacttcaacatcccatattcaaggaggaaagtcggaccgattagtttctaccgataaggagaaatcaggccacaattttataatttaatttcaccttgggctgctgcccacaaaggggtctcggtgccgtgatcagagcgggtgaaaaaaggccgtatccgtaggtgcctcacggtctcaagaaactgcttcaatgtgctcatcgaggttgttgctgatcggccaatatagaacctcgcgcgtgcatagaaccgataaatacaatggcatgtcatgtcctgcctacacaagtacaagagaccaatgcgtactagctccactcatccttctagtaccgtagagtaatcgcctgctaagacgctaagccgaagcctattcttgtccatctgtacgtgcgggtggtagcaccgctttctggcatggattctgacttagaggccttcccttatctacattgttctatcaaccagaggctgttcaccttggagacctgctgcggttatgagtacgacctggcgggagaattattccttcccgcggattttcaagggacgtcgagagcgcaccagacccagcagaggtgccggagtttaacaagattacccaggcctttcggccaagggagtactcgctggctccgtcagtgtagcgcgcgtgcggcccagcacgccacggtcagttcccgggccagttttgattttccgcaaaattcatttgtatgggaaatcaaaaaaatcgactcaccgccaccaaaccgcgcgaccggcgtcggatgactacaacacgacgtacaggttgccaattctcagtgcttgcaaaggaggcattggataagacaatgtggagtcttgcacaccgtcccggcagagagtttgcccatcataaccacgagccaagcacaaatctatctgcacatccagttcagagcctgggtactcttcagaaatacaccggcccacatttaccctcttgcacgccacggtcagttcccgggccagttttgcttttccgcaaaattcatttgtatgggaaatcaaaaaaatcgactcacggccaccaaaccgcgcgaccgatatatgagcctgggtactcttcagaaatacaccggcccacatttaccctcttgcacgccacggtcagttcccgggccagtttttaaactggccgggtgcttgcatgatcatggtgagagtgtctgggtgtgctatgtagtacctttccattttctggtcgaaaagtccaaaaagtgacaaaccacgcccaataaagaccgcatgctgtaccaaatcacgcaaaagacattgctcgatccaatgcgcacggcaatccaccttccccctctcagttccccagggcatccttccaccacaccaagaccactagggccggtgcggcttggcttttatttaattgtaacatctaaatagaatttaataggaataatattcttcatatttatttatatttatttttgtgtatcgctagcgcaagctatgctagcaagcataaaagactaacccttgcagacacatagtctagggagaatgtaatactttaattgttggtgacgacaagaaggtgccgcaaatagggtgtacgccgaaaaatgcgtggcaggaaagcaaagtgtcgtttggcaaagtgtcgtttggcaatgggtcgttctaaaagagtgcaagaacaacgagaatctaacctaaccaatcacatggcagtgcctttcggtacgaaaggtcttcttcctgtatcagtatttattgtcactacctccccgagtcgggattgggtaatttgcgcgcctgctgccttccttggatgtattagccgtttctcacatgtgaacatacctactgttgcttcggcgggattgccccgggcgcctcgtgtgccccggatcaggcgcccgcctaggacacttaggggggggggggggcaggaagcgctgaatgatgatgcagatgacgagaatgagtggctgtatggcctcttgatgttaaaaatcctttttgatgtgagtttggtatataaccaacagaggattactgactattttaattatgttgatacatgaggggttagtgttgcaattggacacgatgcatttgccactcccccccacatcctcagtgagcgcttatcgattgtggaggggtcattcaactcacgtcataattcatcgggagcttgccgacatgtgaaactgatgtcatagtccgccacgagtgctccaatacgggggctcggagccgacagctcacgataagttaaaggtgagcccttggtgctgggctcttccggccattaaaccctagctccggacaaaccgatttcagggtgatagaccgttaagaagaaaagaggtaaactcggtaatgatccctccgctggttcaccaacggagaccttgttacgacttttacttcctctaaatgaccgagtgtggagagctttccggccctgagtggtggtttccctcctctctgggccagtccggacgcctcactgagccattcaatcggtactggagaaggagatgtgcgggatgtaaagatagactggctaccctgcagccgcttcccgagagacagaccgggcgccagttgagttctgtcgttatgctttcaatcatacgccggtatgtggctgccaggtccggtggcaaagatgcgagagcgttcacaatcgccgcctcgtgacgacaccgagccaggctgtccaattgacagataaagctgaaggaattatctaagatctaagacctagtctagggtaggctggttatagggtagcttggtataggttaggtcgtctgagaatatcctaggatttttcccggattttctagacccttatctgggcttataaggctgccaatttggctgcccacggagctgcaatagatagctgtttacaaggcaggtctcaagaaggaacttccacgctaatgcccgccaatttcccttataaacccggtgttgcaatccctctgcagctagaaagaacccattagttggaaacatagagtgagacgctgcaatgaatacacttacagctctcttccaagaatcgtccgcagcaacattggcctgtatctggtaggcctgcttgtcgttgaagccatcaaccagaccgtctttagcctgtagatcaaggcctaagaccatagcaccttcacgaataaaggtggcctttccctctgtggaaccctatgcccttcactgggtgtagcggggaaacaggacttttactttgaaaaaattagagggctccaggcaggcctttgctcgaatacattagcatggaataataaaataggacgtgtggttctattttgttggtttctactatatagtttatattatatagatttaatttatatatatatattatattctaaaactatagtttatatttctttttataagatgcgccgaagctctctcctacgttcactttcattacgcgtaggggtttgacacccgaacactcgcatacgaagacgacagtatttaataatcctattggccggtatgatccgggattggcgtagttgtccttgccttgcttcctcagcacgactgttatcgattcccggaagtgccgtgggcaatatccgagatcctgaccactagctgctagcgatcacaaccactagcttatagcggttgcaaccactagcctctagcgattgcagccgctggccacaatcgctaataaccccctgccaacgctagccaatagcgattgagatcgctatccgatagcgattacgatcaactagtattgatacattcgaatgctcacgttcaattaagcaacaagagcttcttacatatttaaagtttgagaatggatgaaggcggtttgtccggagctagggtttaatggccggaagagcccagcacctctgctgggtctggtgcgctctcgacgtcccttgaggtaggaatacccgctgaacttaagcatatcaataagcggaggaaaagaaaccaacagggattgccctagtaacggcgagaactgagagggggaaggtggattgccgtgcgcggcgtcggtggccctgccgctggtgctgtgttcggcgcgctctcacgaaactgagagggggaaggtggattgccgtgcgcggcgtcggtggccctgccgctggtgctgtgttcggcgcgctctcacgcgtgccattcagtaactaattctccagtgcccctcgtgggcgctggtggccaaccccggcgaacgatagttacctggttgttgtcactttttggaattttcgaccagaaaatggaaaggtactacatagcacacccagacactctcaccatgatcatgcgagcactcaacataacctacactttacataacctgcacctcacatgacctacactttacataacctgcacctcacataacctgcacccctcaacataacctacactttacataacctgcacctcacatgacctacactttacataacctgcacctcacataacctgccccccacaggctatctcaccgcctgtagctcacgctcagtagaccggccctccctgtatctagccactgtcctcgacttaccccgctcgttttaaaattacaatacgcgaaatactacagcacacttctagtaccgtagagtaatcgcctgctaagacgctaattttgcggaaaatcaaaactggcccgggaactgaccgtggcgtgcaagagggtaaatgtgggccggtgtatttctgaagagccgtccttcgcctcgatttccccaatacaggcggccctggtggctggctgcgtagggggtttgggagatggattacagggacgccagagttctggcgcccggtctgtctctcgggaagcggctgcagggtagccagtctatctttacatcccgcacaagccgtccttcgcctcgatttccccaatacaggcggccctggtggctggctgcgtagggggtttgggagatggattacacggacgccagagttctggcgcccggtctgtctctcgggaagcggctgcagggtagccagtctatctttacatcccgcacagagctctccccagaccaggcatcctcagtacgacgtaccgcacgcggccgctttcgtgagggtcgacgcccactatgaaccacccgccagcgaagccgaagccgtctagcctgtccaagtgaccactcagtgggaatctgcaagatacggtacagttgagcccaaccagtacctaaggtacttaaaccactggcagttccttctcaaagaaagatttctgtcggaaggtccaggccttgaacacgttcaatactgctatcctgagggaaacttcggcggaaaccagctactagaaggttcgattagtctttcgcccccatgccgaatctgaataatttgagataataaaaataaaaaaaaatgagtttaactttagtactttttttaattggaatcttaggattagtatttaatagaaaaaatattatattaatgcttatttctatagaaataatgttattatctataacatttttaatattaacaagatcgctgtccgatgcactgtcagcatgatcattggggacagcccggagcagaacatggaattgatgttcatggcacagagagtgatgagggtcgatttgaaaatgtctgggaactctcaaagccaatcgacaaaacggcagattgatgaacgagcttggacgcggctgcagggtagccagtctatctttacatcccgcacatctccttctccagtatcttaggcgatatagccttcagggtacctcattgtgtctggacctggtgagtttccccgtgttgagtcaaattaagccgcaggctccacccctggtggtgcccttgcgtcaatttcttcccttatctacattgttctatcaaccagaggctgttcaccttggagacctgctgcggttatgagtacgacctggcgtgatcccttatctacattgttctatcaaccagaggctgttcaccttggagacctgctgcggttatgagtacgacctggcgtgcgaattattccttcccgcggattttcaagggacgtcgagagcgcaccagacccagcagaggtgctgggctcttccggccattgtcgttggcttccaatcaagctgccttgaattctgctgcgatgggccttccgggcctgggtcaggagcttcattcgtatacctgacccatttctcaactagcgaaatagggataaattgctggataagtgacaagggctctgatggaagagggtgaacttgcggtatggctagctggctggcattaacacaaaacacaattacgctagccaatccgtcatctgtcatctggctataaagggccctctggaggctggctgtgccctggaggcgttagttgtgccttcaggctatgccaccaaaccgcgcgaccgatatacatgactttttttgaagtggtggtcagaataatcagcttcgcgagctctttgaactactggccttctcacttccctccgatccgcgtggaaggcgggagaccggtttgaagttggggtaccgggtaggcagaaactcattatcctctcaccctgcccgaggctgcgtggcggcggcagatttggtttgagttcgccgggtatagggtagctgggtgtggtttctgcctacccggtaccccaacttcaaaccggtctcccgccttccacgcggatcggagggaagtgagaaggcatgcggtgtcgtaaggggccgaggcaagcggcctatctggaccttcttgaggccaaaggatcagctgcttcagggcgatatacaggaagtacggcggcaaggggctgttcgtcagatgttttgggctgtagattaaaaaccaatgcccttcggggctctctggtgattcatgataacttctcgaatcgcatggccttgcgccggcgagggttcattcaaatttcttccctatcaactttcgatgtttgggtattggccaaacatggttgcaacgggtaacggagggtatctagcgaaaccacagccaagggaacgggcttggcagaatcagcggggaaagaagaccctgttgagcttgactctagtttacggtagggggggtcagcgactagcgaaaaagacagcgactcgcaaaaaaaaaagtgacctagcgcgcccgccaaatttggcgtgcagcacatgtactatctttttaatgcacatcccgcttatatcctaagcggaggaaaagaaaccaacagggattgccctagtaacggcgagtgaagcggcaacagctcaaatttgaaatctggcgcaagcaccaccatgtgggccataccaccatgtgggccacttttttaaactttataacttctaattatttttacttattaaccaatataataaaagaagaaattaaaccttttctatacttattttattattttatatctaaaaataatattcttataatagatccccttcagtttacagaaaccatacaccgagatgtatatccgaccgtcgaccccacacaaccaagtctacaacgcatcgcccagggcaaggtcgttgtggtcactggagcaggtagcgggtttggcgaggttcgtctcggttctgccttctatattaccacccttcagtttacagaaaccatacaccgagatgtatatccgaccgtcgaccccacacaaccaagtctacaacgcatcgctcagggcaaggtcgttgtggtcactggagttttgtgtatcattcacccttagcatttcttaattactcctactcatttcattgtcctagcagcgtctcactttgtacaaacatccgctctcatatattgcttacagatattaatagctcgtccctaaacataaggcggcccggaaccttagctctcaacccgacccagagtgtcgtggttgccctagtaaatcagctgccaaaggggacatacccgtctttattgataacctatttacgtctgctgacctctgccgtgctctgcgagagagaggtcacggaacaacaggcacatgccgccgcaactgtggcatttttggtggatcttataaaagctatatatatcggtcgaaggttttggtggttgtgagttgattttttagatttcctatagtaatgaattccctagtaagcgcaagtcatcagcttgcgttgattacgtccctgccctttgtacacaccgcccgtcgctactaccgattgatatagggtgaagccagaggaaactctggtggcggctcgcagcggttctgacgtgcaaatcgatcgtcaaatatgggcatgggggcgaaagactaatcgaaccttctagtaggcttatcgtctccacacttagatcgtatcgataagctgtgtatttaactactggctggggggatgcagacaactgcctgattgagctgaggaagggagatagttagcaccaatattcaagataatgaacaccgaacatcagtcttgcagcagagaggaagtataattttagattaaactaaaataaactctgatatactaatactaaacctaacctaataagactaataccctgatctgaatataactaaagacttcatcgcgcaatgaacggctcgaggctttgaaccaacacgtaagagaggccacagcccaaacacgagcctctaaggaagagtcacctcttcaaagtccgcttggcctacggatttatcatcgttgcggggcaatatcatctctccaactggtatgaagacagcgcgctaccgaaggattgggtcatctccacaactcacaacggctggacgtcaaatgaaaagggtgtagaatggatccagcactttgaaaagcatatgagagaaattagtataattttctggtctctctcacaaaaataagattcttttgtgctatattttgcactatattaggtacctctagcactaaaactcactgagtaatagcggagttagcagttgagagctgtaagttatagcgaacttccctgctgcgaagcctattcttgtccatctgtacgtgcgggtggtatcaccgctttctggcatggattctgacttagaggcgttcagccaaagcctattcttgtccatctgtacgtgcgggtggtatcaccgctttctggcatggattctgacttagaggcgttcagcccttatccagcagatggtagcttcgcggcactgcccggtcggacagccgcaaaaaccaattatctgaatgagcggttcctcttctgtggatggatggccgctggctaaacttaccactgagcaacgggagatcgccacgtgcagcggacaccgccatggtggaagctgtgcgctgagcactcctcttggggcgcccaagccgcaccggccctagtggtcttggtgtggtggaaggatgccgtctgctccaagcttcatcttactcgtctccatcacctgcaacccaagcttctctgcctcctcccaccggccttgattcctatatgttaatgcaagattggccatactcgtcagttcccgggccagttttgattttccgcaaaattcatttgtatgggaaatcaaaaaaatcgactcacggccaccaaaacgcgcgaccgatatacggtcgcgcggtttggtggccgtgagtcgatttttttgatttcccatacaaatgaattttgcggaaaatcaaaagtggcccggaaaatatatttattttttaatatttaaaaatattattataaaaaataataataatttataataataagtagatataataattatagttttaatagtattataatctggaattataagaaatttattataataagaactaagataaataatatagatcttagattaaatataaaaataaaaatagtttttaaatataaacttaatactaattaattagagataattaataaagaaataataataaaaatataaagttaaatataattaatagtaaaagaaaataaaaaagaaatttttaaagctatataatattagaatctaaaaatagagctaaataaataactaataaaagatataatagaatataagaaaagatatttagtataagtatattaaaataaaataattaaagaaggaaaaatagctaaagaatattctaaaagaatactaagtttataataaactatttaaaaaaacttttaaaattaatttattagaatatagctaataggattataagatctttattattaataaagaagaattagctttttataaactctataactttatagaatcttaattataaatactctataaatatattaataatatattaataaaagactatatatagctattaactttatctatagaatatcttataatatttatattaaagaaaaataataaactctatttagttattaattactaatagctaaataagattatatataagaataaaatactcttattactaattatagaatttagagattaattataaggaaaataatagtttattatactagatctaaagagagcttataatctaatataaattaaagaaaataataaatagaaaatagtatttagaataaagtttaatctctataaatactttataatactttttaaactaataaatatatttataatattctaataaataattaattaaatattttaaaagtattttaatatctttatagttatttatcttaataatattttaattttcttagataatctagaaatatataaaggatccgttgttgaaagtttttatttatttgtaaaaactactcagaagattccaaaataaaacaagaattaagtttcctatgcgggcgcctgatccggggcacacgaggcgcccggggcaatcccgccgaagcaacagtaggtatgttcacatgggtttggcatagtttatggttaagactacgacggtatctgatcgtcttcgatcccctaactttcgttcctgattaatgaaaacatccttctcttaaagtaataataactattatccgaggtaatctaatatagctatttactaactatatttattatatacccctctagtgtatccggttcatccttgcgtttcctctttgtagacctgcgtgatttttcacaagctacatttacgctagtctccttatattcgcggcgtttgtcactttttggaattttcgaccagaaaatggaaaggtactacatagcacacccagacactctcaccatgatcatgctattgccttcatccattctcaaactttaaatatgtaagaagctcttgttgcttaattgaacgtgagcattcgaatgtatgaatactagtgggccatttttggtaagcagaactggcgatgcgggatgaaccgaacgcgaggttaaggttcccacagcggatcggaccagcttgttacagttgacccgagacgctgtgagtggtttgctgcagcgccttaggctttcgccttcatgggagggcgtcccgcgggcgctgcagggtatgtaaaatcaaaaaagttgttaagagccgcggtaaattattgttttataccctggagccagggtgtttgtgaggttatagtcttccatgagctcaatgaggtcttccgcttctgcctctcctctagagctatccggacctccccacatctcgtgatgcagattgaagtctccaacaacgatctgctctatttgtcggtccgagtcgagcagataaaagtgggtcttaaaaaagctatatatatcggtcgaacggtttggtggttgtgagttgattttttagatttcctatagtaatgaattttgcggaaaatcaaaagtggcccgggaagcagaatacgccgagctgcacagtagcgacctgttgggcgagttcgtatatgacttcagaggctggtcaccggaaaagttcacacttctaaaccccaatattgttatacttagacatgcatggcttaatctttgagacaagcatatgactactggcagaatcaaccaggtaactatcgttcgccggctctctggtgattcatgataacttctcgaatcgcatggccttgcgccggcgatggttcattcaaatttcttccctatcaggctctctggtgattcatgataacttctcgaatcgcatggccttgcgccggcgatggttcattcaaatttcttccctataaactccatgggcaggacactcgcaacaacgtacggccggcctctcatgatatcttccagggctgccagaacccgcctcccctccgaattggtgcgctatcggtctctggccggtatttagctttagaagacgtatacctcccatttagagcagcattcccaaactactcgcctcgtcgaaggagtttcacagaggctaggcatccaaccgtacggggctctcaccctctatggcgtcccgttccagggaatgcgctatcggtctctggccggtatttagctttagaagacgtatacctcccatttagagcagcattcccaaactactcggctcgtcgaaggagtttcacagaggctaggcatccaaccgtacggggctctcaccctctatggcgtcccgttccagggaaacccaacccttagagccaatccttatcccgaagttacggatctattttgccgacttcccttatctacattgttctatcaatctagcgaaaccacagccaagggaacgggcttggcagaatcagcggggaaagaagaccctgttgagcttgactctagtttgacagcatgtggtaacatacctcaacggctgagagctgtctctcggaaaaaatccgattcgccaccctcatcagaaactggcggctctggttccggttgggctttgggaggacgcctcgggagcaggcagccactagccgggcaaccggccggcggcagccagcacctgggtgcggatgcccttagcaggcttcggccgtccggcgtacggttaacaaccaacttagaactggtacggacaaggggaatctgacgtgtggttgtgagtgtggttgcgagttcggttgcgaatgtggtcgcgagtgtggttgcgagtgtggtcgcgagtgtggtcgtgtttatgatgaggctgaaggcagcgaggatcctactattgtttttttacttattcaatgaagcggggctggatttacgtccaacttctggttttaaggtccttcgcgggccgagccgggttgaagacattgtcaggtggggagtttggctggggcggcacatctgttaaaccataacgcaggtgtcctaagggccgagtcgggattgggtaatttgcgcgcctgctgccttccttggatgtagtagccgtttctcaggctccttctccgggggcgagccctaaccctccgttacccgttgcaaccatgtttggccaatacccaaacatcgaaagttgatagggaagaaatttttgtctgcatccccccagccagtagttaaatacacagcttatcgatacgatctaagtgtggagacgataagcaacagatccgtggtcgcggtttagggggacgggtagtttcggtaggttacgtacgagagtaaaccaaggtccaataacctttggatcttcgcatttagccctctgatagtcatatttccgaccccagcgcgtacgaagctctggttgccgcttaataaagttggaagcccaattgactccaacagggggcgcgtcgcgtactattttatacctatttatactataagtaattactaaaacttagaggtaaatattattcctctatctaatattattttattaggtaatctatcttaggcgatatagccttcagggtagcttagaagagatgggatggcgggtttacaaaagtcatgtatatcggtcgcggggtttggtggccgtgagtcgatttttttgatttcccatacaaatgaattttgcggaaaatcaaaactagtaagcgcaagtcatcagcttgcgttgattacgtccctgccctttgtacacaccgcccgtcgctactaccgattgaatggcctagtaagcgcaagtcatcagcttgcgttgattacgtccctgccctttgtacacaccgcccgtcgctactaccgattgactggctcagtgaggcgtccggactggcccagagaggagggaaaccaccactcagggccggaaagctctccaaactcggtctcctctacactgacgagtatggccaatcttgcatcaacatattggaatcaaggccggtgggaggaggcagagaagcttgggttgagtgctcagcgcacagcttcaaccatggcggtgtccgctgcacgtggcgatctcccgttgctcagtggtaagtttagcccgcggccccacaacagtatacataagcaactggaagtcagccatagcgtgtatcaccccgctaaaattccaaccccagcgcacccagaggccagcatcagttcgccccgggggataaaggctttgggaatgtggctccctcgggagtgttatagcccactgtgtaagcggcagggccaccgacgccgcgcacggcaatccaccttccccctctcagttccccagggcatccttccaccacaccaacaccactagggctgaacgcacattgcgcccgccagtattctggcgggcatgcctgtctgagcgtcatttcaaccctcatgcccctagggcggggtgttggggatcggccaaagcccgcgagggacggccggcccctaaatctagtggcggacccgtcgtggcctcctctgcttagttttaccctactgatgacctcgccgcaatggtaattgagcttagtacgagaggaaccgctcattcagataattgggttttgcggctgtccgaccgggcacggcgatgtgcatgtgctgtggttggatttgtggtggtgcatgcacgctgtggtggaatttacagtggcgtgcattcgctgcattaccgagtttacaactcccaaacccatgtgaacatacctactgttgcttcggcgggattgccccgggcgcctcgtgtgttgccgttgttcttgcactttgcgcaatgccttgtgtgagatccagcctcgtagtgcctcaaacaatactccagagatttctagtgcgttgatacctgctgagaagcccgcgtatatttcagttctttcagttggttagcaatggctggtcttatagcttgccagacgtcaaagagatccaaggtagatatgagcccgggttgaacggcctctagtgcagatcttggtggtagtagcaaatacttcaatgagaacttgaaggaccgaaggggggaaaggttccatgtgaacagcggttggacgtgggttagtcgatcctaagccatagggaagttccgtttcaaaggcgagactctattgtatatctgcaatgcaaccccgacgtcttgatattggattgcacctacaaaacaaataagcatgctatgtcatttcttgatatggtcggcgttgactcctgccaacgctctttctgtatcgccttcgcgtttctctccggtgagacagaggaggactactcgtcaaaaaaatcgactcacggccaccaaaccgcgcgaccgatatacatgacttttgtaaacccgccatcccatctcttctaaggcgcgcaaattacccaatcccgactcggggaggtagtgacaataaatactgatacagggttcttttggatcttgtaatgggaatgagtacaatttaaatcccttaacgaggaacaattggagggcaagtctggtgccagcagccgcggtaattccagcaagagctcgtagttgaaccttgggcctggctggccggtccgcctcaccgcgtgtactggtccggccgggcctttccctctgtgctggcgtaatggtcatcaacgacccgtcttgaaacacggaccaaggagtcgtcttcgtatgcgagtgttcgggtgtcaacacaaatgaccctctggcacaaccgactggcccatctgagcgatgcgaatttacggcggctgaagaagcaagcccacggtattcgagacgtgcaaccacgagaaccatgcaacccttgccttcgggggcgaatgactgaaaacccacacaaaaacccaggaagaaagggagaatactcaatggagcttcttcacatggacgtcgcaggaccgttcgacgaaggcctagacggtagtcgctactggctcaccattgtcgatgattcgaccgggttcgaccccggagaaggagcctgagaaacggctactacatccaaggaaggcagcaggcgcgcaaattacccaatcccgactaacctgtctcacgacggtctaaacccagctcacgttccctattagtgggtgaacaatccaacgcttaccgaattctgctgcggtatgataggaagagccgacatcgaaggatcaaaaagcgacgtcgctatgaacgcttggccgccacaagccagttatattcatgcgcgtcactaattagatgacgaggcatttggctaccttaagagagtcatagttactcccgccgtttacccgctcttggtcgaatggcttcgctttgacattcagagcactgggcagaaatcacattgcgtcaacaccactttctggccatcgataaagttaagatatatatagattataagaatatttaatattttactataacctagtaacttaataggaaataaatctattatactaaatacttattctaatttaattataaaataatatattaaaaaggattagaaaatagaagggctccctccctgtatctagccactgtcctcgacttacagcgcttcccaccctctaaaacaataatttaccgcggctcttaacacagtgtatcaggatggtctgctccaagcttcgtctgaagaatctccatcacctgcacctcaagcttctctgcctcctcccaccggccttgattccaatatgttgatgcaagattggccatactcgtcagtgtagagcagtgtatcaggatggtctgctccaagcttcgtctgaagaatctccatcacctgcacctcaagcttctctgcctcctcctaccggccttgattccaatatgttgatgcaagattggccatactcgtcagtgtagaggaatggtcctcgccaaatagccctctcctaatacgcattcaaaagtcatgtatatcggtcgcgcggtttggtggccgtgagtcgatttttttgatttcacatacaaatgaattttgcggaaaatcaaaagtggcccgggatgtcagcggagctggcggaagagatggtggtgtgcggaatccacccggcggaccacgggtccgaccaccgggccatccgaaccgtgtttgatgtggggacgccggaacgcaaagccagcccacggcggctgtttaagaatgcgccgtggaatgcgatactccatcggagttcaggggctagaccacctcatgatgttgatcagctgtcgaagtgcccgatttgttccggatcaggcaagaacaattggagggcaagtctggtgccagcagccgcggtaattccagctccaatagcgtatattaaagttgttgtggttacaaagctcgtagttgaaccttgggcctggctggccggtccgcctcaccgcgtgtactggtccggccgggcctttccctctgcttcccaccctctaaaacaataatttaccgcggctcttaacaacttttttgattttacataccctgcagcgcccgcggcacgccctcccatgagcctgggtactcttcagaaatacaccggcccacatttaccctcttgcacgccacggtcagttccccccggattttctagacccttatctgggctagataagcccgataacctaataatagctctgctggtggcccggacccctgcgggttcctagggcgcggctctgatcctaacaattgtagtatgtccacctagaacctcgtgtggcgagattttccgctaagtcgtgatttttacccactatgctttgattgcttttgaagctaaacttgaattgctcatcattcggtaagagcttatagcgatcggatgaacgcttaccgaattctgcttcggtatgataggaagagccgacatcgaaggatcaaaaagcgacgtcgctatgaacgcttgcccgccacaagccagttatccctgtggtaacttttctggcacctctagcttcacacgtcgaaggactaaaggatcgatagcgcttaccgaattctgcttcggtatgataggaagagccgacatcgaaggatcaaaaagcgacgtcgctatgaacgcttgtccggacttcatccggcggctacaggcacggcagctgctggaccgggtggttatggacgagtgccacgtggttctggacggaggcgggcggttccggccagcgttggcagcactgggggggatcttgcagtcatggggggtgcagcttgtgtttctgacagcactcgaccactgcttgaagccgagcgatgcggatctggcactagagtgtgcattcgactccatcatggtggatgggtctatgtacgacgaggagggcaatgtcaaatacgtcaaatcggtggtggacagagccaggggcaaggggatcacagttgaggctgagctggggaggatggactttgggacttgctaggcatgcttccgcgccaacgggccaccgttgaccgtctggtggatcgttttctacacgatgtgtgcttgcccatcgacgccgttcatccgtcgtctttccggcaggaatatgaacgtttctacagccggaaagccggcttcaatgacgtgacgactgtagatatccgatggctcgcgttgctcttcattgtccttgctattggagcatacctggattgtccgccgcgtccagcttggcagaggataccgccgcggtggcagacgaggtggttgtcgtcgtggcggcagatccagagcggctggttgcgcttcctccaacggtctgggatcctccggaagtggccgtggccagtgtggtgccggagcctctagaagcggatgaaccttgggtggcctcctgggagttagtcgacgccacagtggctgcagccgctattggttagtgatcgtaatcactatcggatagcgatctcaatcgctattggctagcgttagcaggaggttattagcgactgtagccagtggctgcaatcgctaaaggctagtggttgcgatagctagcagctagtggtctggccgttcttagttggtggagtgatttgtctgcttaattgcgataacgaacgagaccttaacctgctaactagcccgtctttcgctttgacattcagagcactgggcagaaatcacattgcgtcaacaccactttctggccatcgcaatgctatgttttacttagacagtcagattccccttgtccgtaccagttctaagttggttgttaaccgtacgccggacggccgaagcctgctaatggttcccggcgatgtgcatgtgctgtggttggatttgtggtggtgcatgcacgctgtggtggaatttacagtggcgtggattcgctgtggttggatttgtggtggtgtgggtgcgctgtggttgattatgtagtgggttgggtgcgctggggttggaagcttgtctcgtttgcccagctacagatgcgagggattgcacatctctgttggtgctgtaatcttggtagaacatctcaacatccgttggcggcgtggtgttggggatcggccaaagcccgcgagggacggccggcccctaaatctagtggcggacccgtcgtggcctcctctgcgcagcctcgggcagggtgagaggataatgagaggatgcattggatcgagcaatgtcttttgcgtgatttggtacagcatgcggtagggctcgaccccggagaaggagcctgagaaacggctactacatccaaggaaggcagcaggcgcgcaaattacccaataccgactcggggaggaagaagctgtcggattgagaggggttgattcgacgcacagtgataatcaggtacatgaagagggcacacttttagcccctattctcagtactctagaaagtacttccgggagagccggcctgatttggttcttcccttttctttgctctcgatatcgtcagacctcttctgcttcgtcgcattcgaagggaggcactgcaggcggggtttgtgttggtggtgccattgtgcacgctcaagatgtaaggtccagagcgtgcaggggatcttgtgacaggggtgtatggggttccacccttgttagaaggacaagggtctagggttccacagagggaaaggcccggccggaccagtacacgcggtgaggcggaccggccagccaggcccaaggttcaactacgagggttccacagagggaaaggcccggccggaccagtacacgcggtgaggcggaccggccagccaggcccaaggttcaacgacgagctttttaaccacaaccaccgagtcgtcaaacgacttctgctccgcctccaggaaatcgtttgactgatattgcatgttgactaacccacgcatatgataatgagggcttgtagtgcgtgatgaaacaatgagatgggatactgggctacaattcaactaccaaaggcatatatgtaatttcgatcgccatcctagttggagcacttgtgatttgtccggccccgtatgctcttactcaaatccatccgagaacatcaggatcggtcggagatgcgccgaagctctctcctacggtcactttcattacgcgtaggggtttgacacccgaacactcgcatacgaagacgactccttggtccgtgtttcaagacggattaggacccaaatctgatctgaactgatagttgaccactcgaatctgatctgatctgattgattgattgatatctgatgtatagtatcgggcccggggtggcttaaaagttccaagttttcaaaggagtagtgatttttgacctatcagaagggaggttttcctgggccaaccagagcgaagggcttaagttcgggggtagaggcgatcgtcacgaggatacgatcgagggcagtggatcgttggttggatatccgtcggatgaatcgtaggaaattattgacgattggaactgcctcttctggggtcttcgtagccctttggacaagaataggcttcggcttagcgtcttagcaggcgattactctacggtactagaagtgtgctgtagtatttcgcggattgtaattttaaaacgagcggggtcaaatcctttgcagacgacttagctgtgcgaaacggtcctgtaagcagtagagtcatatacgaccttaataaagaaaccacaaccactacattcctcaccggttcaacacattcctcgccgccaaacctgcgtatgctaggcgcagcggttgagtttcaaggtcattgtcacctagtaactgcgctctttaggctggactgttaacttactttaagttaaatattatactttcagcctgggtataggtattaataccttaaaaactctaataataggagctatttatacagccagattcttttaaatattttatctatatatatttatactagatattacttttcttattttattatactttctattaattatttatttagctttattcttaaattctaatataaaatagctctaagaatagcttttttattttttttactattagctatatttaattttatattcttattattattattttattagctatttctaattaattagtactaaatctatatctaagaactatttttatttctatatttaatctaagatttatatagtttatcttagttcttattataataagttttttataattctaaattataatattattaaaactataattattatatctacttattattataagttattatttaggttttttataataatatatttagttattagagaatcttcttattcttctaatatttaataaaattttaatctattaattctaatttaaatatttaaaagtattctattactctatataattagtatactaattaattagtaagtttatatcttataattataataattctaatataatattataatcttctaatagtactaagttatatataatattaaatgtcttttcttaaatcttagttataaaataattagtttctaaattaataattctattattatatttaaattttaaactttctatattagctattatataagtttcttttttctttctttataataagtagaattaattaattactactaataaaatataaatttcctatattctatagttaatttcttttaatttttacttctataagaatatatatagagtttctagtttttattacttctagggttttttaatctattattaatattatactatactatagctctattatagatagtttagattttttctatctaattaatttatttttttaattacctatactaatttatatttattaatatatagaaaaaaagttcttttaaagtatttagttatattatatccttaaataaatactattaaaacttttttatttattttttaattttaattagttttttatatattactctttattcttttttattaatagagattattattaattcctctaaattactattttctctattactaatagagaaaagtacttcttctttatatatatattatagctcttcctcctaatactaatattattaaaagtataatttaatagtatttattactagttctaatactttctatttagttttcttataatttctatatctttagttattatactatttaatctagctattatatatatatattacttgatcttctatatacttctaattatattataatttaaacttattattcttataaaccttatactaaagtccgtgtgatagccgagcatgtggtaacatacctcaacggctgagagctgtctctcggaaaaaatccgattcgccaccctcatcagaaactggcgagttggttgttaaccgtacgccggacggccgaagcctgctaagggcatcagcacccaggtgctggctgccgccggccgggtgcccggctagtggctgcctgctcccgaggcgtcctcccaaagcccaaagttggttgttaaccgtacgccggacggccgaagcctgctaagggcatcagcacccaggtgctggctgccgccggccggctgcccggctagtggctgcctgctcccgaggcgtcctcccaaagcccaacgtacccaacccttagagccaatccttatccagggttagggctcgaccccggagaaggagcctgagaaacggctactacatccaaggaaggcagcaggcgcgcaaattaccagggttagggctcgaccccggagaaggagcctgagaaacggctactacatccaaggaaggcagcaggcgcgcaaattacacaatcccgactcggggaggtagtgacaataaatactgatacagggttcttttggatcttgtaattggaatgagtacaattgtagtaattatccccctattgtttgaggcaagatatcttaccatttcctcatctaggtgaaagtggttgcttcgggacaggtgagaacggcgtatgcctccacgtctagagtccgctgataaggttccaccaggctcatgggagggcgtcccgcgggcgctgcagggtatgtaaaatcaaaaaagttgttaagagccgcggtaaattagtgttttagagggtgggaagcgctgtaagtcgaggacagtggctagatacagggagggccggtctactgagcgtgagctaagctcctattattagagtttttaaggtattaatacctatacccaggctgaaagtataatatttaactttatcttatagttttaaaggttcagatatagactactaattatattcttaaaaaatatatattagattatatattacctgatcttagaatatacctttatttatagtaaacaataatttaccgcggctcttaacaacttttttgattttacataccctgcagcgcccgcgggacgccctcccatgagcctaatcggtagtagcgacgggcggtgtgtacaaagggcagggacgtaatcaacgcaagctgatgacttgcgcttactaggggttcctcgttgaagagcaataattgcaatgctctatccccagcacgacggagtttaacaagattacccaggcctttcggcatctgaggtcaaccttggaaagttgggggtttaacggcaggggctcgtcgctctccgatgcggaatatcactacttcgccgaggaggccacgacgggtccgccactagattgtgtgaatatgctttggtggcattcccagtgaggtgcatgtgctgaagtttggttcccggcgatgtgcatgtgctgtgggtggatttgtggtggtgcatgcacgctgtggtggaatttacagtggcgtgcattcgctgtggttggatttgtggtggtgtcagtagaacaaaagggtaaaagtccccttgattttgattttcagtgtgaatacaaaccatgaaagtgtggcctatcgatccatcagacaccacaaaaggtgttagtacatccagacagttggacggtggccatggaagtcggaatccgctaaggactgtgtacgaaagatgaaaagcactttgaaaagagggttaaaaagtacgtgaaattgttgaaagggaagcgttcatgaccagacttggcagggttagggcgagatgatggagaggaaggggggataataagcacacgagtgctattccggcagcagcagcagcagggtgttagcagggttagggcgagatgatggagaggaaggggggataataagcacacgagtgctattccggcagcagcagcagcagggggttaggggtatatggctcagtgcagagcgggtcaggaagggggcaggggaggtagagcatttccggcggcagctagcaggaattcggtaagcgttggattgttcacccactaatagggaacgtgagctgggtttagaccgtcgtgagacaggttagttttgtactcataaccgcagcaggtctccaaggtgaacagcctctggttgatagaacaatgtagataagggaagtcggcaaaatagtattgcatttgcttttctctcaggcgaatcggaagaagactactcatgggcattacaacacctcaaatcgctctatcagtgtgacctcccgtctgtcgttttgacggaccggtgcctagccgcaatgaatgctgctgctacatggttctcttcatcgaaagcactgctttgcctgtggttagcagggggttattagcgattgtagccagtggctgcaatcgctagaggctagtagttgcaaccgctataagctagtagttgtgatcgctagcagctagtggtcaggatcgctaacagcgatctgaccccactaacttatagtggctataatctctctcgtgagacaggttagttttaccctactgatgacctcgccgcaatggtaattgagcttagtacgagaggaaccgctcattcagcaccgccatggttgaagctgtgcgctgagcactcctcttggggcgcccaagccgcaccggccctagtggtcttggtgtggggttgatctgaccgacatcagatttattccgtaccggcgacgacaccaaaaaggatcctaatccgaattataacatctcgtccacttcctcttaccttgatttatcccccttgtacggcaacaacgtccaagaacaggaagctgttcgcactatgaaagacggcttgctcaagcctgacaccttctctgaacagatagcctgtggggtgcaggttatgtgaggtgcaggttatgtaaagtgtaggtcatgtgaggtgcaggttatgtaaagggtaggttatgttgagtataggttatgtaaagtgtaggttatgttgagtataggttatgtaaagtataggttaggtggcggccacggaagtcatacaaccgatgaatttatgatcaaatgcttccagaatgatatattccttcttttcttaccttcgcattcatcgtgtccacctgtacgtgcgggtggtatcaccgctttctggcatggattctgacttagaggcgttcagccattatccagcagatggtatggacggtggccatggaagtcggaatccgctaaggactgtgtaacaactcaccaaccgaatgtactagccctgaaaatgtatggcgctcaagcgtctcacccatacctcgcgagtgccattcagtaactaattctccagtgcccctcgtgggcgctggtggccaaccccggcgaacgatagttacctgggtgattctgccagtagtcatatgcttgtctcaaagattaagccatgcatgtctaagtataagcaattatacggcgaaacttggagcctgcggcttaatttgactcaacacggggaaactcaccaggtccagacacaatgaggattgacagattgagagcgctttcttgattttgtgggtggtggtgcatggccgttcttagttggtggagtgatttgtctgcttaattgcgataacgaactatttaaactctatcttaagctagcctagctgaaactactactatctcctttaactagctctagttaaaatctatttatcttcttctttttttctctattttatacttattttattaatatatcttattataaatacttactcccttaagctatatacgacgagtcgagtagtttgggaatgctgctctaaatgggaggtatacgtcttctaaagctaaataccggccagagaccgagagcgcacaagtagagtgatcgaaagatgaaaagcactttgaaaagagggttaaaaagtacgtgaaattgttgaaagggaattgtttttttacttattcaatgaagcggggctggatttacgtccaacttctggttttaaggtccttcgcgggccgacccgggtgtggtggtgcatgcacgctgtggtggaatttacagtggcgtgcattcgctgtggttggatttgtggtggtgtgggtgcgtattcgctggtcgtcaccgacccaactactaatccgcccctcacccgtttaactaggcgagagcggacgggatcgcgtgctttcgaacgggtatggtcgtatgtggcagtttcacgtcgaatgatccgggaaaaatcctaggatattctcagacgacctaacctatacccaggctaccctatagccagcctaccctagactaggtcttagatcttggataattccttcagctttaaagataaggtatctaatatctatactcaactgatcagcttaagagcctaggtgcaccgacccacatttaccctcgtgcacgccacggtcggttcccgggccacttttgattttccgcaaaattcatgtgtatgggaaatcaaaaaaatcgactcacggccaccaaaccgcgcgaccgatataacctatacccaggctaccctataaccagcctaccctagactaggtcttagatcttgaataattccttcagctttaaagataacgattcgagaagttatcatgaatcaccagagagccccgaagggcattggtttttaatctaataaatacatcccttccgacgtcgggattttaagcatgtattagctctagaattaccacggttatccaagtagtaaggtactatcaaataaacgataacatttaaattgtactcattccaattacaagatccaaaagaaccctgtatcagtatttattgtcactacctccccgagtcggggtaggtcaacttcaaccctgaataacttcacaactaatagcccaggcgggaagcaaattagataaaaagtatattcagccaacttcggcggaaaccagctactagaaggttcgattagtctttcgcccccatgcccatatttgacgatcgatttgcacgtcgaaacttcggcggaaaccagctactagaaggttcgattagtctttcgcccccatgcccatatttgacgatcgatttgcaggttccattcatgcgcgtcactaattagatgacgaggcatttggctaccttaagagagtcatagttactcccgccgtttacccgccagaggctgttcaccttggagacctgctgcggttatgagtacgacctggcgtgagaattattcctgcccgcggattttcaagggacgtcgagagcgcaccagacccagcagaggtgctgggctcttccggccattaaaccctagcctccaccaactaagaacggccatgcaccaccacccacaaaatcaagaaagagctctcaatctgtcaatcctcattgtgtctgcccgcgaaggaccttaaaaccagaagttggacgtaaatccagccccgcttcattgaataagtaaaaaaacaataggagaagtggtatttcaccggcgccgaagctcccacctattctacacctcctatgtcttttcacaatgtcaaactagagtcaagttgtagaggatgtttctggcgacgtgccttccgagttccctggaacgggacgccatagagggtgagagccccgtacggtgggatgcacggaacttccctatggcttaggatcgactaacccacgtccaaccgctgttcacatggaacctttccccacttcggtccttcattagttctttagattttaatagtttaataatataattaaagaatattaattactatagttattctaatactaaaactagtttaaattctctatatagtttattgaatatgaggaacttcgccgatacatagtgactcaccgagccaatcttcttcgggcggatcggttgtgcgaccatcaatgtctcctcgatgagccgcggtaaattattgttttagagggtgggaagcgctgtaagtcgaggacagtggctagatacagggagggccggtgtactgagcgtgagctacaggcggtgagatagcctgtggggtgcaggttatgtgaggtgcaggttatgtaaagtgtaggtttaaacactctttctagtagccaacaaaattaatgaaaactctttatcccgggagaaaaaatgagaccacggatccacgagaatctgttgcttatcgtctccacacttagatcgtatcgataagctgtgtatttaactactgggcctgttcactggttcgattttgcgagctggcgatcgcacaggccacttcggctgctccttttctaaggggaaggcgctggacataaaacctccgacgcagtctgtgcctagccctctgagtacggatttgagggttagcgacgtcaactgcaggagaaagtagtaaatatatactatacttatagagataaattaactaataatcttatataactaacttttcttatttctaaataaataggaaaagaaaccaacagggattgccctagtaacggcgagtgaagcggccacagctcaaatttgaaatctggcgcaagcccgagttgtaatttgtagaggatgtttctggcgacgtgccttccgagttctgggagaagaggcaataccgagttaccaatatgccagcccggacgaggtcagtgctttcgccatagaaggagggagcaaccacgatagctttacggcacgcccagaagaaactcatcgaggcctctcacgctgaccttatgattcttctccccgcataagaagcagcggtccatccactctgctagctgccgccggaaatgctctacctcccctgcccccttcctgacccgctctgcactgagccatatacccctacacgctgaccttatgattcttctccccgcataagaagcagcggtccatccactctgctagctgccgccggaaatgctctccctcccctgcccccttcctgacccgctctgcactgagccatatacccctaacaccctgctgctgctgctgccggaataggaggaaccgctcattcagataattggtttttgcggctgtccgaccgggcagtgccgcgaagctaccatctgctggataatggccctctatccagtgctttcccagacgcattggagggtctgacggagggagcaaagttgaggctatcgcaataacctggctatgcgacggagcagtgatcgcaaatattgccgtcgatcctcccaaaaatagttggagcgagctgtggaagatctggattttcataactatttagcaaatcccgtgtgtgagaaactctaatgaaaaagcatgcattttatagagttgtctctcgatacacccaccaattcacaatgaccttgaaactcaaccgctgcgcctagcacacgcaggtttggcggcgaggaatgtgttgaaccggtgaggaatgtagtttgatcataaattcatcagttgtatgacttccgtggccatcaaggataagcaacctaggtctcttggtctcgggcttcgtcaacgggataaagatcaggtctagccacgcaagagcgatctcgtcattcgtccagcccgttgcagcatctccttctccagtatcttaggcgatatagccttcagggtagcttagaagagatgggatggcgggtttacaaaagtcgtgttcattatgttcctcgatgattgtccgcatcttccacttgatcctaaaagtaccatgctgacgaaagccttcctgccaaacggtaggcggcgggggtccttcccgatggggtgagccgctcgcttcctgatacacatcgaacgcgtgaaagaccaacccgtccccaatgacctggctaagatgatggctatgagcgcactatctttcgttaacaaaatccacaacattcccgacctcggtaccatacacgacgcggtttggtggccgtgagtcgatttttttgatttcccatacaaatgaattttgcggaaaatcaaaactggcccgggacctgaccgtggcgtgcaagagggtaaatgtgggccggtgtatttctgaagagtacccaggctcatgggagggcgtcccgcgtttaacggcaggggctcgtcgctctccgatgcggaatatcactacttcgcagaggaggccacgacgggtccgccactatatttaggggccgtacgtaacggcattacgcggtagtacgagaaatttgtagatgaagagtggcattgatgagatatcagcgctgagagaatctggttgttattcgtggatcgtgtctagagcttgtgtggaaggaagattgacggctctgagtcgtctgggtttgcttttgactcaggtgtctgacctactgcgccgcatcgcagcaagcgaagcctgagggagatggaatgatctcctagtcgcgtaagcgatgacgcacgtcgttgacagactacatttaagtcggtgagggcggaggattcaaagcttaggagacaatgctttgccggagatcgtactctactgcttacaggaccgtttcgcacagctaagtcgtctgcaaaggatttgaccccgctcgttttaaaattacaataagcgaaatactacagcacacttcttaatggccggaagagcccagcacctctgctgggtctggtgcgctctcgacgtcccttgaaaatccgcgggaaggaataatcccaccatggactacgcatcgacggtgtggacgcacacgtgcgggatcaagcagcagcgatggttgaaccgggcacaaagaataggcgcgcaggcgatcacgggcgccttccgtacgacctagtgacgttgtgtgcttgagtgtctaatccggcatcctgtagagcaggtggtggggcatcttgttcgccggcccttcccgaatgacgggaggggtagctcttgaataagctagcagagaaatatttgtttgccttggatcgattctatttttaacatcgtccgatccctagtcggcatagtttatggttaagactacgacggtatctgatcgtcttcgatcccctaactttcgtctgccacttcctttgctgccgctgtctgatccgctgctgcgttccccgccggtgcttggactgctgccgtctggcctgtctctatctgaccttctgcaacctgggctgccgtaatctctatagctgctggtgctactgttgtaggtattcgttatgtgtgtaatccccgctctcattatcccttcaatttctttaccataggccttcttcagtggcccaaaacagccaacatctccgttgttgaaagtttttatttatttgtaaaaactactcagaagattccaaaataaaacaagaattaagtttcctaggccacagacgcaacaggtgcctctttgactggctctgcaccaaaatatgtatggatagcctgtgcccgggcgtgtgttgttatcggccgcttccggatacgtgttgtaaactctgtgcccttatagactgtggatagcagcagcacaagcgcattatccttatcattcttttattcctggtcaccaggtatgtatacatattggcattgaacaacagaccttttctttgggtgggtacacgctcgactaaatcctcctgccaaggccaccctatacaggcatagttcaccttctttcgggtccggccccgtatgctcttactcaaatccatccgagaacatcaggctcggtcggagatgcgccgaagctctctcctacgttcactttcattacgcgtaggggtttgacacccgaacactcgcatactggcacctctagcttcacacgtcgaaggactaaaggatcgataggccacactttcatggtttgtattcacactgaaaatcagagagccccgtacggttggatgcctagcctctgtgaaactccttcgacgagtcgagtagtttgggaatgctgctctaaatgggcgggacgccctcccatgagcctgggtactcttcagaaatacaccggcccacatttaccctcttgcacgccacggtcagtgcccgggccagttttgattttccgcaaaattcatttgtatgggaaatcaaaaaaatcgactcacggccaccaaaccgcgcccacaaatccaaccacagcacatgcacatcgccgggaaccaaacttcagcacatgcacctcactgggaatgccaccaaacggttctattttgttggtttctaggaccgccgtaatgattaatagggacagtcgggggcatcagtattcaattgtcagagttaccttctataatagtaaatatatactatacttatagagataaattaactaataaccttatataactaacttttcttatttctaaataagtccttctgtcttgggaccccgacatcttgtctagtttcttgactttgttgggataaccggggtagaatgaacaaggtagactaataattactaaactgaaaaattcatttccatctgtgccgttgacctcagaatgagaatctgtcaaaagcgccgctaaagtataacccaataggtaataaggaaggtcctcagcctccatcaactgaaaaatacttgcgatattacgttactcaagtacgtacattgaactgaaaaattcatttccatctgtgccgttgacctcagaatgagaatctgtcaaaagcgccgctaaagtataacccaaataggtaataaggaaggtcctcagcctccatcaactgaaaaatacttgcgatattacgttactcaagtacgtacattgatattctaatctttagatataattatatactaatttagatttcttttattttaatatatagctagatattttattagtagctaaataataatataatccaacgcttaccgaattctgcttcggtatgataggaagagccgacatcgaaggatcaaaaagcgacgtcgctatgaacgctttggcctgttaacgtggctaaacccttgatgagcccgtatgtgatgaagccggtgtttgggcccttccgggcaccctcaacacctccctcaactcctccaagggccgggatgaagcgtaaatatcattacgaaccggatatttcaacgcccaagggcagccgaaaacccacatcaaggagctggtctagcctaaaggtatatatctcggccgggcctagctgagatgtctctaaagatagcctataggtagacctaaatgagatctataaagcatattagtttgaatagtttaatcttaatagagaaggaattatagtggattgacagaagcaatggatggagtgagtggcaggcgggtcgagatttgggggttgaaggggagtaatcattggggaaggactgggaggttagctgaaatctggcgcaagcccgagttgtaatttgtagaggatgtttctggcgacgtgccttccgagttccctggaacgggacgctcttgatcattcaggacctatccaaccttgggggatgccattgatgcttaagatttgtcttgcgcgggcgatcgcgttggacctaggtagcgtagggcttccagtctagtagtgctgatcgattttgtgaagcattagagccccgagcctgctatacctccgcggtgcactctgcctgcccaggccagcatcagttcgccccgggggataaaggctttgggaatgtggctccctcgggcgtgttatagcccactgtgtaataccctggggtggactgaggttcgcgctctgcaaggatgctggcgtaatggtcatcaataggcgtatccatcacacttccaaccaccttccctacacctgcggcagatcggcttctcttcgtcgcattttttacgacgcgctctaacatttagctagaggtgccagaaaagttaccacagggataactggcttgtggcggccaagcgttcatagcgacgtcgctttttgagcctctttggcagtacgctggcttcttagagggactatcggctcaagccgatggaagtttgaggcaataacaggtctgtgatggccttagatgttctgggccgcacgcgcgctacactgacggagccagcgagtactcccttggccgaaaggcctgggtaatcttgtaatccatctcccaaaccccctacgcagccagccaccagggccgcctgtattggggaaatcgaggcgaaggacggctcgatgagaagtgagataagtcgaccggaaggatcacaacgatccttaaagacgaacccttccttgttcaaatgctgatatagatactggataggggtccggccttgtagccggcttttgcgatgctgggctatgatattcgagatatcctttgtaatgaatccgctgtgggaaatctcttcaactgtaccgtatcttgcagattcccactgagtggtcacttggacaggctagacggcgtcggcttcgctggcgggtgattcatagtgggcgtcgaccctcacgaaagcggccgcgtgcggtacgtcgtactgaggatttgattttccgcaaaattcatttgtatgggaaatcaaaaaaatcgactcacggccaccaaaccgcgcgaccgatatacattaggctgtatgagaaggggcattatcatgcataaagatatcccctggactaacaatatcaggcaatatagctgaatatagatcaacaatatgctggccctatactcaacataacctacactttacataacctgcacctcacatgacctacactttacataacctgcacctcacataacctttttattattccatgctaatgtattcgagcaaaggcctgcctggagcactctaattttttcaaagtaaaagtcctgtttccccgctacctaacaagctggaataagaaaaggaggaggcttttccaactagatgtgaggcccttgtggatgaagaattccgagagggtgcacaaaggaggagtgttcaagagcgaaggggcagggagggccggtctactgagcgtgagctacaggcggtgagatagcctgtggggtgcaggttatgtgaggtgcaggtttcaacccgggctcacgccctaggcttcgtcactgacctccacgtccgcctactcctcagggcatcgtttctaccctgagtgcgaggtatgggtgagacgcttgagcgccatccattttcagggctagtacattcggtttgccgatgcctatgccgacgcgtacgcttcttactacaagcgtgccaccgtcctccaggcccgtgctggttgcgtaagttaggttaggtggcgtgtgttgtgtgtgaatatgctttggtggcattcccagtgaggtgcatgtgctgaagtttggttcccggcgaacagcgctggcccctaacatgcatgtctgtatttgtgagacactaactacttcctagctagttgcgatgacagccaccgttgattgaatgtttaagactgtgtacatggtcgttggtgcccgacgggatagcctcccgtaaggagactagcgtagacgtggcttatgaagaattgcgtaggtctacaaagaggaaacgcgaggatgatccggatactagaggtatggcaacccaggtgcttgttggaagagagtctaacgtatcaggaagcgagcggctcaccccatcgggaaggacccccgccgccagcctaacctacacccagattaccctataaccaagcctaccctagactagaccttagatcttaaataattccttcagctctaaagataaggtatttaatatctatactcaactaatcagaaagactagctctttcagataaaagtgggtcttataaaagagcctaacctacacccagattaccctataaccaagcctaccctagactagaccttagatcttaaataattccttcagctttaaagataaggtatttaatatctatactcaaaactccctgaatggcgatcgtagaccataatgcaacgtaggccactcaacatcgcacatctctagtttggcggctcggggatcaccgctaggactttctgctcataggtaagtcctagacaaaattcaactgcataagcggaatttaaaaggggttacttgctccgtccagcccttgattgtcgcggtgggtccaaagtcggtcgatttccggtggcaatattgattctctcggcctgtggttggggtggccatcgagtggctgtgcctgttggctccggactatattattaatatataaaatattatatagtataaataactatatataaatagatattagattaatattaaatctgtattattcctaataaaaacctttaaattaactaataatcttatataactaacttttcttatttctaaataagtataattttagattaaattaaaataaactctaatatattaatactgaggttattaaagggaagagatttttagtggaagtggccgactcacttgtgtggccgactcacctgtggattacgttacttgattttgattctcttggctttctgcgacgtcttcgccgattgccgtttgacggggccgcattccgaagaaattgtgtgcgtcggtgtctgaacttcgatgcagcagcggaatctgaatctccgtatcatagttacgggcaagcacgtcgtccacatcggcgttgggcgtggtttgtgcgccaccctgtggacctgtctcaatctcatctagcatccggagatggagcatctcctagaaaccaacaaaatagaaccacacgtcctattttattattccatgctaatgtattcgagcaaaggcctgcctggagcacattgggataatcttaggattatgtgcgcagcaacaaggtgtgataggaagatgcctagggcgcatgacggaaaacggaaggtggttttattatccatcaactcccaagtgtggtggatcggtctcgagtttgttgggcggaaattgggataatcttaggattatgtgcgcagcaacaaggtgtgataggaagatgcctagggcgcatgacggaaaacggaatgtggttttattatccatcaactcccaagtgtggtggatcggtctcgagtttgttgggcggaaagtaagttaacagtccacgccggcgagagcagagctctccccagaccaggcatcctcagtacgacgtaccgcacgcggccgctttcgtgagggtcgccgcccactatgaatcacccgccagcgaagccgaagccgtctagcctgtccaagtgaccactcagtgggaatctgcaagaacggcttaccaggttggttgggccccatcacaccgaatgtggtactctctacacgtccaacagctatgtgtgcttcgagtagaaaccttatgaatcattggtccttgatcgaaattgtacgacatcctctctatacgaaggaaaggtgttacaattgtggagaagttcagctgcactgtagccttctcatttaatcagctcgcaccttggaccaatgaaagtgatgaaagcctcgtatacaaaagtaagcccgcgcagtcaattctaaaaccctacccggcttgcaacagcgacttagtcctaacttggaaggaacgtatatacagaatatagctatgggatctgtcagagggacataatgcccttcggggctctctggtgattcatgataacttctcgaatcgcatggccttgcgccggcgatggttcattcaaatttcttcctgttattattgactggatcccgcgtgctcttgcggacctagttagtgccgcttccgcaactatgccgtgggcgcctccgctgatcggcaatagttgctgcggggcatgctattgtcgaggtaccttaccctacagcagcctgaccatctccgcaagttgaaacttgtctcagccatgccattgcctcttcaacgaggaatccctagtaagcgcaagtcatcagcttgcgttgattacgtccctgccctttgtacacaccgcccggcgctactaccgattgaatggctcagtgaggcgtccggactggcccagagaggagggaaaccaccactcagggccggaaaggccagtagtgcgtgatgaaacaatgagataggatactgggctacaattcaactaccaaaggcatatatgtaatttcgaccgccatcctagttggagcacttgtgatttgtcatggccacacccaccctggagttattgaagtgaaggccttgctatagaatcaggaacgaaagttaggggatcgaagacgatcagataccgtcgtagtcttaaccataaactatgccgactagggataggacgatgttaaaaattgactcgttcggcaccttacgagaaatcaaagtgcttgggctccagggggagtatggtcgcaatattactttataagtagtaagctattaaaagcttatattttatatctatttatactataagtaattactaaaacttagagataaatattattgtcaatttttaacatcgtccgatccctagtcggcatagtttatggttaagactacgacggtatctgatcgtcttcgatcgcctaactcataacctgcacctcacataacctgcaccccacaggctatctcaccgcctgtagctcacgctcagtagaccggccctccctctaagccatagggaagttccgtttcaaaggcgcactttgcgccgtgtggcgaaagggaagccggtcaatattccggcacccataggtgcaccgacccacatttaccctcgtgcacgccacggtcggttcccgggccacttttgattttccgcaaaattcatctcttcgtattctcgctgtacttctgggcgcgcatcacgaggacaatccaggtatgctccaatggcaaggacaatgaagagcaacgcgagccatcggatatctacagtcgtcacgtcatctaaaccggctttccggctgtagaaacgttcatattcctgccggaaagaatcagaacagctctccatctccaattcttgatagaatcaataagattgcaaagggtacacagcgtgttatgcatgaggtggcaatcctacgtgaggaggttgctactcttcgggtcggtgcacctatgagagaggggcgcgagtgctgaaggcgaaagcctaaggcgctgcagcaaaccactcacagcgtcgcgggtcaactgtaacaagctggtccgatccgctgtgggaaatctcttcaactgtaccgtatcttgcagattcccactgatctcgccgtataattgcttatacttagacatgcatggcttaatctttgagacaagcatatgactactggcagaatcaaccaagtgcttttcatctttcgatcactctacttgtgcgctatcggtctctggccggtatttagctttagaagacgtatacctcccgtgacgcgcatgaatggattaacgagattcccactgtccctatctactatctagcgaaaccacagccaagggaacgggcgtggcagaatcagcggggaaagaagaccctgttgagcttgactctagtttgacattgtgaaaagacataggaggtgtagactctctcataggtgcaccgacccacatttaccctcgtgcacgccacggtcggttcccgggccacttttgattttccgcaagcacagctaagtcgtctgcaaaggatttgaccccgctcgttttaaaattacaatacgcgaaatactacagcacacttctagcgggagagcccgttgctgttcacgctcatctgcaatggtgtccatgttagtgcataatccagatcaggaaagacttcacaggaagggcctgcacgaccgccaatttagggttactacgaaccacatcttggtccctccgtggcgggacttgccgtaaaccgagggagccacattcccaaagcctttatcccccggggcgaactgatgctggcctgggcaggcagagtgcaccgcggaggaccacggatgatcaacctgcccaagtctggtcatgaacgcttccctttcaacaatttcacgtactttttaaccctctttacgctaatgcccgccaatttcccttataaacccggtgttgcaatccctctgaagcccgaagttgatcaccgatatcaacaccgccaatacccagggccttgccattggcggagttgatgacggtgatgaggtccggaacagccgcaatcactgcctcactatcatcatcgcgccgatggcgagcgagcaaattctcgttcatgaagggaatgtgaaggtctccgcccgcagccatagccggcctttccccacttcggtccttcaagttctcattgaagtatttgctactaccaccaagatctgcactagaggccgttcaacccagaaatacaccggcccacatttaccctcttgcacgccacggtcagttcccgggccagttttgattttccgcaaaattcagttgtatgggaaatcaaaaaaatcgactcacggccaccaaaccgcgcgaccgatatacatgacttttgcatacgaagacgactccttggtccgtgtttcaagacgggtcgttgatgaccattacgccagcatccttgcagagcgcgcacctcagtccaccccagggtattacacagtgggctataacactcccgagggagccacattcccaaagcctttatccccccctcttggggcgcccaagccgcaccggccctagtggtcttggtgtggtggaaggatgccctggggaactgagagggggagggtggattgccgtgcgcggcgtcggtggccctgccgctggtgcatatttgacgatcgatttgcacgtcagaaccgctgcgagcctccaccagagtttcctctggcttcaccctatacaggcatatatttgacgatcgatttgcacgtcagaaccgctgcgagcctccaccagagtttcctctggcttcaccctatacaggcagagttcaccttctttcgggtccggcccataggcttcggcttagcgtcttagcaggcgattactctacggtactagaagtgtgctgtagtatttcgcgtattgtaatgttaaaacgagcggggtcaaatcctttgcagacgacttagctgtgcgaaacggtcctgtaagcagtagagtagccttgttccagcatagaggttggagagctattttaataagctgagattcgggatttaatatgctcagactgtatgcttgcctcatatgcagtctgtggtatctttagaacccagggctgccttatctcaggcagggtctctggtggtgttggtgttcgcagtgccacatctagctttgacggttatccaagtagtaaggtactatcaaataaacgataacttatataatgagccattcgcagtttcgccgtataattggtggaactgatcctcgccaacgaggttcttcacggtctccacaaagcgttggttcaaccccagggacccggccatgccaccttgtgattagtcagcgccaaacaaacataccaggctcacgatttgggcttacctgtaccgggaacaagctccttgagttgaagatttggcgtcagcgctaatcagggaggggttggcttctccgacctccgattcggaagttgccattggtctgcctctattcaccgagtagggcgaaaaaaaaaaattcccaccagacacaggacaaccaccaccctcatccgcgggtatgcctccatcgccagatatgccgccatcggcggaggcagatatgcgttatgaccatccttgtgctatataccatcgatacattgcagcacgtacggcgtggtataacaagctgccctaactaatgtgtgtaagacttagatactatatagaactagcccagccctaacatctactaatatatcctctccctaacatataagaatatatacaatgagtgtaacttaggctcctttcgcataagttgatctgaaaataacccacgccgacatgtgccccgggccagttttgattttccgcaaaattcatttgtatgggaaatcaaaaaaatcgactcacggccaccaaaccgcgcgaccaacaaaatagaaccacacgtcctattttattattccatgctaatgtattcgagcaaaggcctgcctggagcactctcattttttcaaagtaaaagtcctgtttccccgctacacccagtgaagggcatagggttccacagagggaaaggcccggcccggcaaccccatatcagatggttgaggcgacaatgaggcaggtagaggggcatccgtggtaggcctaccataggagaaatcgccggcagaagtgtgctccagtgccgggggctcagcggctctctgtgagctcacacaggctagtaaatcacgggaaaccgcagggagcaatagggtagaaggaaaagcacaatcgaggaacaggcgcattatgggcttgaggagacctatttcaattggtgcatggcgggaaagccaatacgtcgtctcgcaaagtgtcctttggcaatgcgccgtttccaaaaagagtgcaagaacagaagattaaaatattattaagataaataactataaagatattaaaatactcccggagtacttaattaattatttattaaaatattacagatatatttattagtccgaagggtattataaggtacttatagaggctgaactttattctgaatactgttttctatttatctaaccagcctaccctagactaggtcttagatcttgaataattccttcagctttaaagataagatattcaatatctatactcaactgagcacctcacataacctgcaccccacaggctatctcaccgcctgtagctcacgctcagtagaccggccctccctgtatctcgccactgtcctcgacttacagcgcttcccaccctctaaaacaataatttaccgcggctcttaacaacttttttgattttgttgacccgaaggaaatcaattctcttgccttggagcgttctaacctccgggttacggcgtaagaatccctccatccaacgtcttccaatagggtcaaggtcaccctcttcgcacagcttgtctcgtttgcccagctacagatgcgagggattgcacatctctgttggtgctgtaatcttggtagaacatctcaatatccgttggcgtctcaccccaaggtaccatttcagagtaattgggaaccacatcctcttgattagcatcgcaaacgtatcctagtcggcatagtttatggttaagactacgacggtatctgatcgtcttcgatcccctaactttcgttcctgattaatgaaacctagtcggcatagtttatggttaagactacgacggtatctgatcgtcttcgatcccctaactttcgttcctgattaattaaaacatccttggcgctgtggttgattatgtagtgggttgggtgcgctggggttggaattttagcggggtgatacacgctatggctgacttccggttgcttatgtatactgttgtgggttgttttagtagggtaggtgccctgtaactggccgggtgcttgcatgatcatggttatagccagatgacagatgacggattggctagcgtaattgtgttttgtgttaatgccagccagctagccataccgcaagaagtgaaacccacccttgcgctaacctcccagtccttccccaatgattactccccttcaacccccaaatctcgacccgccactttcgatgtttgggtattggccaaacatggttgcaacgggtaacggagggttagggctcgaccccggagaaggagccggagaaacggctactacatccaaggaaggcagcaggcgcgcaaattacccaatcccgactcggggaggtagtgacaataacagaggtgaaattcttggatttattgaagactaactactgcgaaagcatttgccaaggatgttttcattaatcaggaacgaaagcagaggtgaaattcttggatttattgaagactaactactgcgaaagcatttgccaaggatgttttcattaatcaggaactaaagcaaggcaggtctcaagaaggaacttccacgctaatgcccgccaatttcccttataaacccggtgttgcaatccctctgaagcccgaagttgatcaccgatatcaacgaaatcggatggcctctggaggctaatcgtctttgctggtgaggtgactcggccttcagcgaaagagcggctagagagaatagggagagcactctcgcagccggattcgttccttcgtcgcctccagcaggaagtgacacttgaaccagtcttggttcacgcatcaccgcctgagggaaacttcggcggaaaccagctactagaaggttcgattagtctttcgcccccatgcccatatttgacgatcgagttgcacgtcagaaccgctgcgagcctccaccagagtttcctctggcttcaccctatacaggcatagttcaccttctttcagtagtttttacaaataaataaaaactttcaacaacggatctcttggttctggcatcgatgaagaacgcagcgaaatgcgacaattatacggcgaaactgcgaatggctcattatataagttatcgtttatttgatagtaccttactacttggataaccggggtaattctagagctaatacatgcttaaaatcccgacttcaaatccgacgttgagggctatcaaataaatcaaatatgactccggatttgatttgtttgatttgagggcagcgctgccagtgcttagctttgtctggttatggactgatcctgaactgcccaaggatctgggttcgttccataaacttgacgacctacgttgggctttgggaggacgcctcgggagcaggcagccactagccgggcaaccggccggcggcagccagcacctgggggctgatgcccttagcaggcttcggccgtccggcgtacggttaacaaccaacttagaactggtacggacaaggggaatctatatatatagcttttataagacctacttttatctaaaagagactcttaagctgatcagttgagtatagatattgaatatcttatctttaaagctgaatatatatagcttttataagacctacttttatctaaaagagactcttaagctgatcagttgagtatagatattgaatattttatctttaaagctgaaggaattattcaagatctaagacctagtctagggtaggctggttatagggtagcctgggtatacctgccggactatgcaattgcgacagggaagcgatccgtcacactaaccggaaaagtatcagctggccgcgcacgacatcagcgtcatatgaaaaaaaaagggggataggggacccaagaccttctgcttccgagtatgacactgtgagcaagctttggcaatccggccacggagaacgcctctgagaatgattcacctggtcgcatggatatcataccatccgatccagagccaaaccatacggcattgtcgtcccacggcggcatggaatcatcttgaaggaacggctgttgcggcacgcctcccagcacagacgagaacccttgagagcctgcagtagtagactgggtggcggattgaaactgagtttgcccggcctgcctgtcgcgttgttgttcgcgcgtgttgcctgcaggaagttgttgctgttgttgctgttgttgctgttgttgccctcagggcatcgtttctaccctgagggcgaggtatgggtgagacgcttgagcgccatccattttcagggctagtacatgcggttggtgagttgttacacagtccttagcggattccgacttccatggccaccgtccaactgtctggatgtactaacactaataatgactgagtcacacccggagcgcgttatgccttttttgagcgcgccgtagcctcttcggttgccgaggccattcgctaggttccccgttgcggtgcactctgcctgcccaggccagcatcagttcgccccgggggataaaggctttgggaatgtggctccctcgggagggttatagcccactgtgtaataccctggggtggactgaggttcgcgctctgcaaggatgctggcgtaatggtcatcaacgcttcttctttttttctctattttatacttattttattaatatatcttattataaatacttactcccttaagctatatactacctctaactatatactaactctaaatactctctaactctaaccctaagtaaccctaatgctcacgttccctattagtgggtgaacaatccaacgcttaccgaattctgcttcggtatgataggaagagccgacatcgcaggatcaaaaagtgcaaatggaggcgttcttccaattggtgaccgtattccacggtcgtgtgggttgaagctacttatcacgaaacctgcatttgcgagacagattgtatgattgtaatagcttgattcttttaactacggcctggtcggattcttccttttaaaggaaggtacgtcggataagaggcgatgttaccatactgtttgctgcgctacaccttagctgtcgctcacacagtgcatcgtgttattagcctgcattaattagctatagcctgaaggcacaactaacgcctccagggcacagccagcctccagagggccctttataatgtcaaatacgtcaaatcggtggtggacagagccaggggcaaggggatcacagttgaggctgagctggggaggatggggggaggagaggacgggctaccgacgattgacctcgagagcgtcttcaccgatcccgacatggctgctgactttgtcaagtgtcaggtggggagtttggctggggcggcacatctgttaaaccataacgcaggtgtcctaaggggggctcatggagaaccgagtcagtgctttcgccatagaaggagggagcaaccacgatagctttacggcacgcccagaagaaactcatcgaggcctcttcgtattctcgctgtacttctggcggtctcaagaaggaagccccacgccaatgcccgccaaggtcccttaataacccggtgatccaatccctcttgctgccgtagctgacacacacaacacacgccacctaacctatactttacataacctatactcaacataacctacactttacataacctatactcttttaccacgatttcattttcaattcaacgtagtataaccctacgaaaactcctcaatgacgctacgcggctccttgtaggtcccaagcgaacgatatgtaatatcatcatacccaaatgccgcaaggcctccggctctcagacccggatcgttgtcattggagcagtggaaggaagaagaagaagaagaagaggatgaacctgcaacccgtggccacccaccaactaagccaactcaacaagttgaactgcatctcgaagaaccatttgatatcgagagatacaaaccaagaattgtggctgatcccaaaacaggggccaaaacctggatggtatcaaccacagacttggaatggtatgcgattcgagaagttatcatgaatcaccagagagccccgaagggcattggtttttaatctaataaatacatcccttccgacttcctatcataccgaagcagaattcggtaagcgttggattgttcacccactaatagggaacgtgagctgggtttagacggtcgtgagacaggttagttttacccggtggccctgccgctggtgctgtgttcggcgcgctctcacgagtgccattcagtaactaattctccagtgcccctcgtgggcgctaagataattagctaaataaaagttattaatatataatagttagataatttatactaaatagagatttagaatagattaaaattaaactaattagaatattattctgagtaatataatcagattattataaactatataatataaattactattaatatataaatattatagagctagtaataataaatatatagataattatcgaaaccacagccaagggaacgggcttggcagaatcagcggggaaagaagaccctgttgagcttgactctagtttgacagtgtgaaaagacataggaggtgtagaataggtgggagcttcggcgccggtgaaataccactactcctattgtttttttaccactgagtggtcacttggacaggctagacggcttcggcttcgctggcgggtgattcatagtgggcgtcgaccctcacgacagcggcctatctactatctagcgaaaccacagccaagggaacgggcttggcagaatcagcggggaaagaagaccctgttgagcttgactatcttctttattattatatagtaattaagataagataattagctaaataagagttattaatatataataattagataattataatttatactagataagaatctagagtagattagaattaaactaattagaatattattctaagtagtataattagattattataagctatataatataagttattattaatatatttctaggaccgccgtaatgattaatagggacagtcgggggcatcagtattcaattgtcagaggtgaaattcttggatttatttactttacataacctatactcaacataacctacactttacataacctatactcaacataacctacactttacataacctacacctcacatgacaacggccatgcaccaccacccacaaaatcaagaaagagctctcaatctgtcaatcctcattgtgtctggacctggtgagtaacggccatgcaccaccacccacaaaatcaagaaagagctctcaatctgtcaatcctcattgtgtctggacctggtgaggttccccgtgttgagtcaaattaagccgcaggctccacccctggtggtgcccttccgtcaatttctttaagtttcagcctaacggccatgcaccaccacccacaaaatcaagaaagagctctcaatctgtcaatcctcattgtgtctggacctggtgagcttccccgtgttgagtcaaattaagccgcaggctccacccctggtggtgcccttccgtcaatttctttaagtttcagcctattccatgctaatgtattcgagcaaaggcctgcctggagcactctaattttttcaaagtaaaagtcctgtttccccgctccacccagtgaagggcatagggttccacagagggaaaggcccggccggaccagtacacgcggtgaggcggaccggccagcttcacactttgcggaatctatcacacgcatgaacccctacacgtagaggacgatgccagcagttgtcgtcgacgggcgcgccatctatattaatatatacccggaaacatagaggcaccggaatataccacagagcatcgaattcaacgtcgctcactgaggttcgcgctctgcaaggatgctggcgtaatggtcatcaacgacccgtcttgaaacacggaccaaggagtcgtctgcgtatgcgagtgtcagttttgattttccgcaaaattcatttgtatgggaaatcaaaaaaatcgactcacggccaccaaaccgcgcgaccgataccgctgcgagcctccaccagagtttcctctggcttcaccctatacaggcatagttcaccttctttcgggtccggccccgtctgatagagcgatttgaggtgttgtaatgcccatgagtagtcttcttccgattcgcctgagagaaaagcaaatgcaatacagaaggatcgttggcaggagtcgactccgaccatatcaagaagcggcatatggtacttgtttgtcttataggtacaatctaataataggacatccgaaaaaagtggttaagagccgcggtaaattattgttttagagggtgggaagcgctgtaagtcgaggacagtggctagatacagggaggggttagtacatccagacagttggacggtggccatggaagtcggaatccgctaaggactgtgtaacaactcaccaaccgaaggagaggaatcgcttgtgtccaaaatgatgtcggcaatcaagccgaccatgacgggacaaaatctgcatcggatgaatgctgaagcactcaagtatatcggatcatgcattaataatattggaggggaaggtcttaacgtgcctaacgcttatcggttcgattagtctttcgcccccatgcccatatttgacgatcgatttgcacgtcagaaccgctgcgagcctccaccagaggttcctctggcttcaccctatacaggcatagttcaccttctttcgggtccggccccgtatgctcttactcaaatccatccgatcctcggtcaagttcatccaccatcggcaccaagcatcatgccctcgtttctcaagaggtcatccttgcggctgggcctttcggcacaccacagatcctgaagttgagcggtgtaggtccaaaagacgagttggagaggtttgggattcgtgtcgtcccatagctaaggtccggtaaatgaacgtgttagccttggtgcccttattgtagaaaccaacctggcgggggttgagactcacatgataatagttgcgtatgtataatagacgatgccagttcctcttacactattaaaactttctatctctaaaatatggcaagatttaatagagtaaaaggtttgcaaacctttaaaaaaaagactttctgtttcttaggccttggacataacccggggatggcgctcaagcgtctcacccatacctcgccctcagggtagaaacgatgccctgaggagtaggcggacgtggaggtcagcatgtgctgtggttggatttgtggtggtgcatgcacgctgtggtggaatttacagtggcgtgcattcgctgtggttggagttgtggtggtgtgggtgcgctgtggttgattatgtagtgggttgggtgcgctggggttggaattttagcggggtgatacatggctagtccagcacctcagagtcgacttcgaaacctgccctaaagggttggagacaggctggtaagttagacactgaagtagaaatgagacaagttttctcgtgccctaggttgaaagtgctcaacttggttggcctggctgacacgttgaaggcagaatcaacgccattgcaagaactacgggatgcctcagagacaggtgaggtgcttgggcagtccgacttacccagcactttcggcgacaggtactctcaacctgccatatttcgctatcgtatgggtttgatgccacacagaccactgtggttttactgagtgttcctatgaagataaattgagcaagtataggctgaccttgcattggaagggtaaattcttatgagactttaaacccaatttggagtattgatgccgaggtgatacacgtctcgatgctactgatgcccatgtgctgcagcatcctgcgatccatgttgaatttagagttattgcttggtgtcacgcgcccgcactcgtccagagatttctgttctccatgagccccccttaggacacctgcgttatggtttaacagatgtgccgccccagccaaactccccccctgacaatgtcttcaacccgggtcggcccgcgaaggaccttaaaaccagaagttggacgtaaatccagccccgcttcaccaccacaaatccaaccacagcgaatgcacgccactgtaaattccaccacagcgtgcatgcaccaccacaaatccaaccacccaccacaaatccaaccacagcgaatgcacgccactgtaaattccaccacagcgtgcatgcaccaccacaaatccaaccccagcacatgcacatcgccgggaaccaaacttcagcacatgcacctcactgggaatgccaccaaagcatattcacacacacgggggctatatattgccttcatccattctcaaactttaaatatgtaagaagctcttgttgcttaattgaacgtgagcagtcgaatgtatcaatactagtgggccatttttggtaagcagaactggcgatgcgggatgaaccgaacgcgaggttaaggtggaaccctatgcccttcactgggtgtagcggggaaacaggacttttactttgaaaaaattagagtgctccaggcaggccgttgctcgaatacattagcatggaataataaaataggacgtgtggttctattttgttggtttctaggaccgccgtaatgacttcttactgcagaagcatggccagccaaattggaagccgttccggaccttacacgagtggcgggagcagatttctcattatctcctctctcaatacggtcaaaaagcaagcctacggcagaggaaccacacgggagacataaatacgcctgttttacagggggcgaaagactaatcgaaccttctagtagctggtttccgccgaagtttccctcaggatagcagtattgaactcagttttatggctattgaagatcatatacaccaaagcctgattgactcactgcctcgcagagtagctgcaatcatagaagcccacggctggtatacaaaatatccccgtgttgagtcaaattaagccgcaggctccacccctggtggtgcccttccgtcaatttctttaagtttcagcctttcgaccatacgtcgagagcgcaccagacccagcagaggtgctgggctcttccggccattaaaccctagctccggacaaaccgatttccgggtgatagaccgttaagaagaaaagagaactctgcctggggcccccgccgtcgtctccgcgttcagttgcgttgccgccaaggtacgaaaactgccttgaaggatcgtgccaagtggccatgaatgcacgtttatgccacaccacatgtactgttggacagccagcagaggtggaaagccaatgacggtccagactttgcgtcttgcgttgagtgtgtgatggttataacagactgcgaacccaggctcggtccgaatgtgactctgagcgagattgacgaggtcctcgatcaagcccaggaagcagctttagcgggttttagagtagtttttagtcggtagacctatgagagaaattagtataattttctgatctctgcagggagtttgttgcggcggaattgaacaatctagcttccgacgtattctcatcccaaagctattacagaataatagcaagaaaacacataaattcagtgtctcccaacgtctagaagacatctaacaccagtggaagttgctgaatgctagctgagtttttttctggttagtatttacagaagctaacgctcggttattcaagagctgttttggcaatatggcaactgccgaaacccattttgatggtctcttgactctactaggcctctacgattcgagaagttatcatgaatcaccagagagccccgaagggcattggtttttaatctaataaatacatcccttccgaactcgggcgagtttggagagctttccggccctgagtggtggtttccctcctctctgggccagtccggacgcctcactgagccattccatcggtagtagcgacgggcggtgtgtacaaagggcagggacgtaatcaacgcaagctgatgacttgcgcttactagggacaatttcccttataaacccggtgttgcaatccctctgaagcccgaagttgatcaccgatatcaacaccacccatgttgttattataatccgctgaaactgacgggatctgaaggaatttgaccggctttccgctaaattccctcttgatcgtactgctatcctgagggaaacttcggcggaaaccagctactagaaggttcgattagtctttcgcccccatgcccatatttgacgatcgagatccgggcttgaaaagaggttatccaagaagacgtgataaatagctggcggcagccgttttactaggctaattaccatagcttgtgtcggattgaggctgtattcatcatctctcttcctcttccttgttcgaggcttgttatcgccaacagagtcaaataccttacgaggcaggtgcggcggccttgcgccggcgatggttcattcaaatttcttccctatcaactttcgatgtttgggtattggccaaacatggttgcagggaggtagtgacaataaatactgatacagggttcttttggatcttgtaattggaatgagtacaatttacatcccttaacgaggaacaattggagggcaagtctggtgccagcagccgcggtaattccagctccaatagcgtatattaagttgtgtgtgaatatgctttggtggcattcccagtgaggtgcatgtgctgaagtttggttcccggcgatgtgcatgtgctgcgaggttaaggtgccagagtagacgctcatcagacaccacaaaaggtgttagtacatccagacagttggacggtggccagggaagtcggaatccgctaaggactgtgtaacaactcaccaaccgaatgtactagccctgaaaatggatggcgctcaagcagaggcacctgttgcgtctgtggctgctgattataacgattatatgggtgctgtagatcagggtgaccagcttcgggcccaagagggattggaacaccgggtttgtaagggaccttggcgtcgtgtatggtaccgaggtcgggaatgttgtggattttgttaacgaaagatagtgcgctcatagccatcatcttagccatgtcattggggacgggttggtgtaccacacaatcactgaaatcatttcgtatacacagaacaacattaatattaccatttaagaatccgcttcattgttagattctactttctgctttttgaagtacggatataatagtcatatacggcttgtttccttttcttgagtatctagaaatgtaaatgaattttgcggaaaatcaaaagtggcccgggaaccgaccgtggcgtgcacgagggtaaatgtgggtcggtgcaccgatgagagaggggcgcgagtgctgaaggcgaaagcctaaggcgctgcagcaaaccactcacagcgtctcgggtcaactgttacaaatgaattttgcggaaaatcaaaagtggcccgggaaccgaccgtggcgtgcacgagggtaaatgtgggtcggtgcccctaatgattagggacccgggggctatatattgccttcatccattctcaaactttaaatatgtaagaagctcttgttgcttacttgaacgtgagcattcgaatgtatcaatactagtgggccatttttggtaagcagaactggcgatgcgggatgaaccgaaccaccagagatcctacctgagataaggcagccctgggttctaaagacgccacagactgtgtacgaggcaagcgcacagtttgagcatattaaatcccgaatctcagctcatcaaaatagctctccaacctctatgctggctgcaatggatcaatttacatcgcctgctaagacgctaagccgaagcctattcttgtccatctgtacgtgcgggtggtatcaccgctttctggcatggagtctgacttagaggcgttcagccattatccagcagatggtagcttcgcggcactgcccggtcggacagccgcaaaaaccagatgtggatgagcagctaagaggggaagaccgcagaagtggtagccagggagggcaggctcgtacgaagactccacgatgtagcaactgcggaaagcctggttataatatccgaacctgtataaaatataagcttttaatagcttactatctataaagtaatagttaaatagaatatttaaattaaactctggaataatagaggtaaagcgaatgattagggacccgggggctatatattgccttcatccattctcaaactttaaatatgtaagaagctattgttgcttaattgaacgtgagcattcgaatgtatcaatactagtgggccatttttggtaagcagaactggcgatgcggagttgtcgtgggatccaaaagaaaatctcattatgttcctcgatgattgtccgcatcttccacttgatcctaaaagtactatgctgacgaaagccttcctgccaaacggtaggcggcgggggtccttcccgatggggtgagccgctcgcttcctgataccccctgctcctcagatggacaccatgtttttcacggctacaatgtaaggacattcactagcaagccttgacaagctcaacatggcggcgcctaaacagaacatctccatcagaacactgtacaacttgatgtacaaaatcatcgactcctgctacggccagaacctcgggttgggcaggttgatcatccgtggttctccgcggtgcactctgcctgcccaggccagcatcagttcgccccgggggataaaggcgttgggaatgtggctccctcgggagtgttatagcccactgtgtaataccctggggtggactgaggttcgcgctctgcaagtcctaggcaaatcgagctcctggaacagcggatagcggagcttgagggagatcgcttccgaacaccaggggcggagtctgatgcattgatagcattgcttcagacgacactgtctgtcgtatcgttcgcattggaagacctctccttgccagatgagtcctttatcgatgatcttgttggcatcctctggcctggtaaactcgatgattaccgatgatgccgacttggttggcgatgtccgaatccttcttttgtcctacatcagcatcctgatggaccagctttggtggtgggtttggcttgggacccgttcgccgagaatttccagaattacgccaataaaactaataccctgatctaaatataactaaaaataatataaagcttaaataattaatttttaagagctacctctaccctaattaacttaatacagtatataatatactaaaactataaattatatatcaggttatagtaggcctatataagtaggtagctgttcttaagataaataaaactaataccctgatctaaatataactaaaaataatataaagcttaaataattaatttttaagagctacctctatcctaattaacttaatataatatataatatactaaaactataaattatatattaggttatagtaggtctatataagtagatagctattcttaagatatagcccgtattgctttggcagtacgctggcttcttagagggactatcggctcaagccgatggaagtttgaggcaataacagggaatgtggctcaaacattgagcagagtttggcttcattttgtgattagaatcgactcttttacaatttttcgcgatcggatttggtcataactctttcatatcagattatttcgaacgatattatcataccggcgtgccaacttgtctatgttcgacacatttgcacggtcaatgaagcagaaaagatagagcagggctacgattggcacgatgtagaggtcgatcttgttgcgaagatgcctctcggtcggtctgggaaagcactggatagagggctttttaaaacggaacccggaaattaagacgttacgaggcaagcgaattgatcttcttcgtatcaatggggctacggctgaccggggcgatctgcacccggtggaagaatatcttctcctcccccggtgggagcgttgctgtcagaaacacaagctgcaccccccctgactgcaagatcccccccagtgctgccaacgctggccggaaccgcccgactccgtccagaaccacgtggcactcgtccgcccgcgaaggaccttaaaaccagaagttggacgtaaatccagccccgcttcattgaataagtaaaaaaacaataggaggagtggtatttcaccggcgccgaagctcccacctattctacacctcctatgtcttttcacaatgtcaaactagagtcaagactcggggaggtagtgacaataaatactgatacagggttcttttggatcttgtaattggaatgagtacaatttaaatccgttaacgcaggctaccctataaccagcctaccctagactaggtcttagatcttagataattccttcagctttaaagataagatatccaatatctatactcaactgatcagctcaagagcctctttcagataaaaggcgcgcaaattacccaatcccgactcggggaggtagtgacaataaatactgatacagggttcttttggatcttgtaagtggaatgagtacaatttaaatcccttaacgaggaacaattggagggcaagtctggtgccagcagccgcggtaattccagggttgtgattatacgccaagcaatgtctcctcttcaggttcagacatgggtattgacgctctcacatcttcgcgcgtgcatagaaccgataaatacaatggcatgtcatgtcctgccctgccaccctctggggaggggcgcaacggaatttgtaactcaggacacttttgtaaccctcttaacgtattaacatactcgggttgacaacacaagtcggtcagatttagcagaatcgtactctacttttattgactcacggttgttagtcatttctgtcactctagctgttccaaggttgacctcagatcaggtaggaatacccgctgaacttaagcatatcaataagcggaggaaaagaaaccaacatggattgccctagtaacggcgagtgaagcggcaacagctcaaatttgaaatctggcgcaagcccgagttgtaatttgtaggtgtgctatgtagtacctttccattttctggtcgaaaattccaaaaagtgacaaaccacgcccaataaagaccgcatgcggtaccacccgccagcgaagccgaagccgtctagcctgtccaagtgaccactcagtgggaatctgcaagatacggtacagttgaagagattgatcagggaactcaagccactcagggatcaatagaagttattgcgatacaagtggcctcccaaccgctcactatacgataacaaaacccacttttatctgaaagaggctcttaagctgatcagttgagtatagatattgaatatcttatctttaaagctgaaggaacggacctcgtgtccgctgtacgagaaccttagcacttagttagtgaacctcgtaaccactgtagcagctgcattagcggtcctcgtgtccgctgtagcgcttgcattagcagacctcgtgtccactgtacgagaaccttacagcggttacgagcccgtattacagaaggcaacgtgttatcttcagcggagggatcattaccgagtttacaactcccaaacccatgtgaacatacctactgttgcttcggcgggattgcccctggcgcctcgtgtgccccggatcaggcgcccgcctaggaaacttaattcttgttttattttggaatcttctgagtagttttcgggaacgcacgagcgaggcgcctctcataattaagggacaggaggtccggccgaagcgggccgtcaagatcttggggtgacgatggacgcggagctgcggtacaaggaccatgtggccaacgcggcgacgaggggactcgaggcggccatgtgtttccatatctggtatttgaccggtaggagataggtttcgatatccaaggcaggagctgatgtggctttgaaagcaccggttatcactctggccgctcgtgcttgccaggtgcttatgcccatatactcttctttcctcctttgccttaaagagatacctacaaggataacccccaaggcgccacctacctggtatacaagcccaaggttcaactacgagctttttaaccacaacaactttaatatacgctattggagctggaattaccgcggctgctgtcactggcgtcggacagtccgaaccagtggcgtttggctcaaagctaaagactcttcggacaatcactacatactgtggtcccctccgacatggaggtgctccgacagttcgccgaggattgggaacaccgggtcggcaacggggccaccgtccgcattccatatcgaatgcctgcgtgaatctcgtactgaggcattccggcacctggtgtccggctcgcgcctcctagcctcgttgatggatgtgtctccgatttcctcaccaggtcatcgatccaccgatgagactgctattccggaagatttgcaagggtcttgacgaacaacaagtgaagatatcacttaactaagttggttgttaaccgtacgccggacggccgaagcctgctaagggcatcagcacccaggtgctggctgccgccggcggggtaaccaatagctgaagcacgtcgcttggacgtttgagaggattttcggactctaccgacaagttctatgtcagccttgggatgatgtcgccgggtccacttgtataagttccgtttcaaaggcgcactttgcgccgtgtggcgaaagggaagccggtcaatattccggcacctggatgtgggttgtgcgcggcaacgcaactgaacgcggagacgacggcgggggccccaggcagagttctcttttcttcttaacggtctatcaggaaatgcgccacatgtcatggagaccatgaagcctggagcaaccattgcccggaccggaaggaagagatgaatagaatcaaagcggcatatctcacaaggccatgctcgaatacattagcatggaataataaaataggacgtgtggttctattttgttggtttctaggaccgccgtaatgattaatagagaactctgcctggggcccccgccgtcgtctccgcgttcagttgcgttgccgcgcaaaacccacatccaggtgccggcatattgaccggcttccctttcgccacacggcgcaaagtgcgcctttgaaacggaacttccctatggcttaggatcgactcgacttagctgtgcgaaacggtcctgtaagcagtagagtagccttgttgttacgatctgctgagggtaagccgtccttcgccgccgtgtggcgaaagggaagccggtcaatattccggcacctggatgtgggttttgcgcggcaacgcaactgaacgcggacaagcgcaagtcatcagcttgcgttgattacgtccctgccctttgtacacaccgcccgtcgctactaccgattgaatggcccagtgaggcgtccggactggcccagagaggagggaaaccaccactcagggccggaaagctctccaaactcggtcatttagatagcccagccagctgcatttaccccttggatcacagttgcccactcccggttaccaggctggactagcttagcctttatacgaccctctgaggtagtaaccaccattccagggaagataacccccatcataaagccggtctcgtcaaagttgtatagtttcacgaattgcctcctcaacttcttgttccgtgattggtggtgtgttgatctggtcactgtatacggcatgctcgatgtcacttaagtcggcctcgggtggaatggggaagaacgcttctctgaaaagcattgctttggcactgggctcagttgcctcgtggcctgtcgatagcgtatattaaagttgttgtggttaaaaagctcgtagttgaaccttgggcctggctggccggtccgcctcaccgcgggtactggtccggccgggcctttccctctgtggaaccctatgcccttcactgggtgtagcggggaaacaggacttttactttcgatactggattcctggtacaaatatagctgtagatgagtgtattcagcactttgagggcagaacgcttgagaaagtcattattaaatctaagcctatacctgaagggtttaaaatctgggctgtagctgaagctggctatttcctctcgtggctgccgcacctgcctcgtaaggtatttgactctgttgagtggtaaggttagccagcggccatccatccacagaacccatccagcgccggcgagagcagagctctccccagaccaggcatcctcagtgtccaggggatatctttatgcatgataatgccccttctcatacagcctacatcgtaagagctctgctaagggagctacgtatagaggttatgatctggccaccttactcgcctgacgcacccaacccactacataatcaaccacagcgcacccacaccaccacaaatccaaccacagcgaatgcacgccactgtaatccctgagcaggtactccttgacggaaaagtgggcaagatgtagttcatcatcggtggcgtgaacaactgtcactaagccggggcagtagtccaacacatcggcgtcgcgatatagtcgacgcttgacgtcatttagagggtgggaagcgctgtaagtcgaggacagtggctagatacagggagggccggtctactgagcgtgagctacagtcggtgagataacataattatgcccaaggtgggattcgaactcacgacctaaacaacttcaacgttccgctcaacctctgagcttctctagctttatatatatcactaggaaatctaatttccttatttttatttttttttaatactactataaaataagtactaaaaggtagaaacgatgccctgaggagtaggcggacgtggaggtcagtgacgaagcctagggcgtgagcccgggttgaacggcgtctagtgcagatcttggtggtagtagcaaatacttcaatgagaacttgaaggaccgaagtggggaaaggttccatgtgattgtgctgctgctatccacagtctacgagggcacagagtttacaacacgtatccggaagcggccgacaacaacacacgcccgggaatgaattttgcggaaaatcaaaagtggcccgggaaccgaccgtggcgtgcacgagggtaaatgtgggtcggtgcacctctgagagaggggcgcgagtgctgaaggcgaaagcctaaggcgctgcagcaaaccactcacagcgtctcgggtcaactgtaccagaaagtggtgttgacgcaatgtgatttctgcccagtgctctgaatgtcaaagcgaagccattcgaccaagcgcggggaaacggcgggagtaactatgactctcttaaggtagccaaatgcctcgtcatctaattagtgacgcgcatgaatggattaagattgccgactatcccattacggagaaagtcaagtttgcagaactctgggaaaataggacgagggcacagatggtttcccttgaggaaggcgtttttgaccattggtttttggaccgtattgtgttggctggtgatgcagctcataaggtagtttttttttttttttttttttttgcgcggcaacgcaactgaacgcggagacgacggcgggggccccaggcagagttctcttttcttcttaacggtctatcacgaatgcacgccactgtaaattccaccacagcgtgcatgcaccaccacaaatccaaccacagcacatgcacatcgccggtaaccaaacttcagcacatgcacctcactgggaatgccaccaaagcatattcacacacaacacacgccacctaacctatacgaatgcacgccactgtaaattccaccacagcgtgcatgcaccaccacaaatccaaccacagcacatgcacatcgccggcaaccaaacttcagcacatgcacctcactgggaatgccaccaaagcatattcacacacaacacacgccacctaacctataaaccagcctaccctagactaggtcttagatcttaaatagttccttcagctttaaagataagatattcaatatctatactcaactgatcagcttaagagtctcttttagataaaacgaactggggtcagccgtacaacttcctcggagtttgctgccctgtccccgaccaaaagaatggctgggcatgcggccttctttcgaccttcgatcgcttgtcgtcactgcatcgcgtctttctcaactactcattctcagtctgggtgccacgtcatgttccctttctttgaatgcgtatctctcggaaaccactttcaaggttcttgcgccaattgtctctatcacacgtacggtgattgcgagtatcccaccaactaagaacggccatgcaccaccacccacaaaatcaagaaagagctctcaatctgtcaatcctcattgtgtctgctagaagtgtgctgtagtatttcgcgtattgtaattttaaaacgagcggggtcaaatcctttgcagacgacttagctgttcgaaacggtcctgtaagcagtagagtagccttgttgttacgatctgctgagggtaagccgtccttcgcctcgatttcccggaagcatttgatcataaattcatcggttgtatgacttccgtggccatcaaggataagcaacctaggtctcttagtctcgggcttcgtcaacgggatgaagatcaggtctagccacgcaagagcgatctcgtcattcgtccagcccgttgcagaagctgtaaaaaagaactctagcaataattgtatgtatactgtatgccggtaccagaactgatgtaggcgatcttaaaaagaagtatagggtggacctgttggctggtggttgtttcttcagtggacattgaaatatagagatatagggtaggcgtagggtaatgatagtgaagtgatccggtgttttttttggacctaccgcaggcaacgcaagctgatgacttgcgcttactagggattcctcgttgaagagcaataattgcaatgctctatccccagcacgacgggcgttcagccattatccagcagatggtagcttcgcggcactgcccggtcggacagccgcaaaaaccaattatctgaatgagcgcccccctcatgctgccagcggcgaacgtcatgccacatcttatcgtaacggccaagcttcctctgtatgtggcagcacattgcacaaattgtaggttgttcttcggtctcatagaccagcatgaggccacaagtctggcctatgcggtattccctgttgtcatcagacgatatccttcatgtgtcagatatgatcaatgatcagctacaattccgcctaacaacagggtttatgacctagtgatgagagagctccatcgcccctgcatggttttaccagtccgttacatcaaggtactaaatttagccccttttcatcctggcatgctaggggtatgtgtctctcttctgatgttgttattataatccgctgaaactgacgggatctgaaggaatttgaccggctttccgctaaattccctcttgatcgggcgtgatattctcttcaataacgcgaacacagtgtacaatttgaggttggaacttcgtccactagcggtgtcacctggcatcgatcatcatgaacagcctctggttgatagaacaatgtagataagggaagtcggcaaaatagatccgtaacttcgggataaggattggctccctgggcctggctggccggtccgcctcaccgcgtgtactggtccggccgggcctttccctctgtggaaccctatgcccttctaaataccggccagagaccgatagcgcacaagtagagtgatcgaaagatgaaaagcactttgaaaagagggttaaaaaggacgtgaaattgttgaaagggaagcgttcatgaccagacttgggcaggttgatcatccgtggttctccgcggtgcactctttactagtaaaataagtagggatagctctcacaagaccatccggcgtagccacgcctcgcaaccttccccaatgccacaagttcttaccagctgtatcatctaccttagcccggataaaaggctcaaaaatgccacagttgcggcggcatgtgcctgtttcaaacttccatcggcttgagccgatagtccctctaagaagccagcgtactgccaaagcaatacgggctagttagcaggttcaaacttccatcggcttgagccgatagtccctctaagaagccagcgtactgccaaagcaatacgggctagttagcagggtaaggtctcgttcgttatcgcaattaagcagacaaatcactccaccaactaagaacggccatgcaccaccacccacaaaggtcctgtaagcagtagagtagccttgttgttacgatctgctgagggtaagccgtccttcgcctcgatttccccaatacaggtataaaattaaatataattaatagtaaaagaaaatagaaaagctattcttagagctatttaatattagaatctaaaagtagagctaaataaataactaataaaaagtataatagaataaagaaaataatacttaatataaatatatatagataaaataattagaagaaaaagaataattaaaaaatattctagaagaatatagagtttataataaactatttaaaaaaactcttaaaactagtttatttaaatatagttagtagaattataaaatctctattattattagagaaaaactagctttttataaactctataactttataaaaccttagttataaatactctataaatatattaataatatattaataaaagactatatataactattttttttatctatagaatactctataatatttatattaaagaaaaataataaactctatttagttattaactactaataattaaataaaattatatataaaaatagaatatctttactactaattataaaacttagaaactagctatagataaaataataatttattatactagatcttaagagaacttataatctaatataaattagagaaagaaataaatagaaaatagtatttagaataaatattagatatgtaccccgattaggatgtgtgagtggagagacccacaatatgaatcaaaaagaagtgaaaatatgatcgtttaggctctgcgataataacaaaaattgctatgttttaattagacagtcagattccccttgtccgtaccagttctaagttggttgttaaccgtacgccggacggcggaagcctaatcgaaccttctagtagctggtttccgccgaagtttccctcaggatagcagtattgaactcagttttatgaggtaaagcgttttaccacgatttcattttcaattcaacgtagtataaccctacgaaaactcctcaatgacgctacgcggctccttgtaagtattcaatatctatactcaactgatcagcttaagagcctctttcagataaaagtgggttttataaaagctatatatatcagtcggtagcaacctcctcacgtaggattgccacctcatgcataacacgctgtgtaccctttgcaatcttattgattccatcaagaattggagtcgtcttcgtatgcgagtgttcgggtgtcaaacccctacgcgtaatgaaagtgaacgtaggagagagcttcggcgcagctccgaccgatcctgatgttctcggatggatttgagtaagagcatacggggccggacccgaaagaaggtgaactatgccattaacaggccacaagccggaccccttccagcccgagcgaatattcgtatctgttagaccgatcaatcgagcctttgtataacctcgaaacctcaaagcccacgtagaccgggcgattgaacaaagcggcaatgagcacattaagcatatcagagtagcctcgactaaccagctcaagagcggcgatttgagcatcataggtactaaagacaggaaacattacaccttcgagaagctgtgggattttcaaaagagttggtagccgaggttcaatcaagcctcaatgacttaaaggagagttatctgggctagataagcccgataacctaataatagctctgctggtggcccggacccctgagggttcctagggcccgcgagctgacaagctggacagtagcattgcccagccgagcactaagaagggaaggtgctgggcgggactgttgggcctttaatccaaaactcatcttcagccatggaagtcggaatccgctaaggactgtgtaacaactcaccaaccgaatgtactagccctgaaaatggatggcgctcacgcgtctcaccttgatagcctttgactgtcgatcaatcattgtccccttgttataatttcacaattgtaacgccatcggtgtttgtaacgtcctttttgatgggcttttggtggtcgatcgcagatcgacctcctttgtgggaatctcgttaatccattcatgcgcgtcactaattagatgacgaggcatttggctaccttaagagagtcatagttcctcccgccgtttacccgcgcttggtcgaatggcttcgctttgacattcagagcactgggcagaaatcacattgcgtcaagccagagtagacgctcatcagacaccacaaaaggtgttagtacatccagacagttggacggtggccatggaagtcggaagccgctaaggactgtgtaacaagtaatttgtagaggatgtttctggcgacgtgccttccgagttccctggaacgggacgccatagagggtgagagccccgtgcggttggatgtccatgccagtggtctatcactgtcgggattgatacggcagactgcagtatggtatcacatactgatcaacatactttttcggccaaccactggcagcggcaatcccaagcgcttgcttcatgacttgagattcactgacttggatgatttctctctgttaatatagcgccacatagcgccacagtaagtggaaccctatgcccttcactgggtgtagcggggaaacaggacttttactttgaaaaaattagagtgctccaggcaggactttgctcgaatacattagcatggaataataaaataggacgtgtggttctattttgttggtttctaggaccgccgtaatcatctgcagaccatgagaacgcaggggtggggtagcgagggaggtaatggacgactttgggaggtgatgacaggcatggaatacttgctggaacacctggaagatcggaagctgttctatcaggctgctgtgtgttgccctggcagtgctctgtcgacggccttggagtactttccaactctgttgaggcggatcttcggatcctgcgggggaccaataggtacgcacctgggtgcgcacataagtgtcacgtgctgcgcacccggtgcgcgtgtaaggaagttatgagctctgctctcgccggcgctggatgggttctgtggatggatggccgctggctaaacttaccactgagcaacgggagagcgccacgtgcagcggacaccgccatggttgaagctgtgcgctgagcactcctcttggggcgcccaagccgcaccggccccttggcgacaataagatcctgtctccatcccactgctgccactcgacgcctcacgtcatggagtagttgtcgtgggatctaaaagaaaatctcattatgttcctcgatgattgtccgcatcttccacttgatcctaaaagtaccatgctgacgaaagcccctactagaagatggaagaattgttgggactccaaatgccgaattccaagaagcccttagcactccctccacacagactgtacaagatgtgggagctagacaagatagctcacctgaggcaacggctgctgccgcaggggggagtgagacggtggggctactaaaccaaccgtcggtaagtatacggcaagcatccgtggcaggctctggacgtcacgcgtctgtggcagcaccgccggagcaagtcttgcctgaaacaagccacggggacttgcaaaaactaccccggacgagcactgaggacttgcaaaaactaccccggacgagcactgaggactcggaagtactacctcgggcgagcaccaaggactcgcaagtactaccttgggcgggcgatgaggacttgcaaatattacctcgggcgagtgacgatgactcgcaatcactatctcgatcgagtgacgatgactcgagagagcgagagccatcccaatcgagtgatgatgactcgcagccagttgctgaaaagggagataggaccttgtcacctcttgggagtgacgatactttcgggtccttttcggataccccagaaagagacgatacactacccaacggtggccagcaacgggatggcgctcgacatgaccaagactcgggagaacggcaacgacatccgagtgtccagtctggtcatacagttcatggagtgaggcaagaggccttagaatatcaccctgaactcagaatccgtgtcccgcaggccgcatcagatacatccgataatagcgacgacgagcttatgctaattaatgtatctgaaggcaacgtaatcccgacgctcttgacagtagctgcggaagaaacggaaccctttgaacctaaaaccgttcacgaagcaaagaacgatacaagctggcccgaatgggaaaaggcgatgcttgaagaagtcacttcactcaaacaaaacaagacgtgggagctcgttgaccctcccagaggtcgacgggtcctcagtggcaaatgggtcttcaagctcaaacgaggatcgcacggagaagttacccgccacaagagcagatgggtggttaggggcttcacacaagaagagggcatcgactacgatgaaacgttcgcctctgttgtcaagccaatgagctacaaggctttatttgcaatcggggctgctctaggcctcgagatcgaacaaatggatgtcaagacggcctttctatatggcgacatagatcatgagatttatgtcgaacagcctcatcacatgatggacggcacatcgagggtctgcaagctccgaaaagcactctacggcttaaagcaggctcctcgcatctggtaccaaacgctcacgaacttctaactggcttgtggcggccaagcgttcatagcgacgtcgctttttgatccttcgatgtcggctcttcctatcataccgacgcagaattcggtaagcgttggattgttcacccactaatagggaacgtgagctgggtttagaccgtcgtgagacaggttatttgcggtttcacaactgtagcaccatcgctgtttgtgacaacttttgatgggtctttggcggtagatcgagtcgatctgtcattaaccccttgttgtaattttacaactgtaacattatatatcttaaccttatatattatccctaagtagtagtatttaaattctttaaatatatatataatagctataaattccttattataaatagagtaattaagttctatactatatacctattttttttttacttattcaatgaagcggggctggatttacgtccaacttctggttttaaggtccttcgcgggccgacccggggaccgagtttggagagctttccggccctgagtggtggtttccctcctctctgggccagtccggacgcctcactgagccattccaggcaggcctttgctcgaatacattagcatggaataataaaataggacgtgtggttctattttgttggtttctaggacccaggcaggcctttgctcgaatacattagcatggaataataaaataggacgtgtggttctattttgttggtttctaggaacgccgtaatgattaatagggacagtcgggggcatcagtattcaattgtcagaggtgaaattcttggatttattgaagacggggtgcaggttatgtgaggtgcaggttatgtaaagtgtaggtcatgtgaggtgcaggttatgtaaagtgtaggttatggtgagtataggttatgtaaagtgtaggttatgttgagtattccgtgacaacctatccctttggatatctcctgacaatggtcagcggggagcctcaacccaagggaaattaagggagaagctttctgcaacatgttaaaatgaatgaaatataggtatcaactgcaccgacccacatttaccctcgtgcacgccacggtcggttcccgggccacttttgattttccgcaaaattcatttgtatgggaagcaccgacccacatttaccctcgtgcacgccacggtcggttcccgggccacttttgattttccgcaaaattcatttgtaggggaaatcaaaaaaatcgactcacggccaccaaaccgcgcgaccgatatacatgactttttttgaagtggtggtcagaacggcccagaacatctaagggcatcacagacctgttattgcctcaaacttccatcggcttgagccgatagtccctctaagcagccagcgtactgccaaagcaatacgggctagttagcaggttaaggtctcgttcgttatcgcaattaagcagacaaatcatatatatatataaattaaatctatataatataaactatatagagaacttaaactagtcttagtattagaataattatagtaattaatattctttaattatattattaaactattaaaatctaaagaactaataactagagtagattgtcgccaagaggagggaccattttgtcaatatatgtgtaaacttccagccgggacgcgaaggccctctctcagcgctcctcaacgatctgaaacgggccattgagcagggcgagggcaaggacgacgaagaggcacaagggagcgggggtgagaatggcacagaggcatacactcgcatacgaagacgactccttggtccgtgtttcaagacgggtcgttgatgaccattacgccagcatccttgcagatcgcgaacctcagagacgactccttggtccgtgtttcaagacgggtcgttgatgaccattacgccagcatccttgcagagcgcgaacctcagcccaccccagggtattacacagtgggctataacactcccgagggagccacattcccaaagcctttatcccccggggcgaaagacgactccttggtccgtgtttcaagacgggtcgttgatgaccattacgccagcatccttgcagagcgcgaacctcaggccaccccagggtattacacagtgggctataacactcccgagggagccacattcccaaagcctttatcccccggggcgaagctatcaaatatgcacagccttaaaataaacttaaagtattacattctccctagactatgtgtctgcaagggttagtcttttatgcttgctagcatagcttgcgctagcgggaaacaagccgtatatgactattatatccgtacttcaaaaagcagaaagtagaatttaacaatgaagcggattcttaaatggtaatattaatgttgttctgtgtatacgaaatgatttcagtgattgtgtggtacttgtcgtcgttgttgtcgttgtcgtcgttgttgtcgttgtcgtcgttgttgtcgttgtcgtcgttgttgtcgttgtcgtcgttgttgtcgttgtagaccggtttgaagttggggtaccgggtaggcagaaaccacaaccagctaccctatacccggcgaactcaaaccaaatcggccgccgccacgcagcctcgggcagggtgagaggataatgagaggatgcattggatcgagcaatgtcttttgcgtgattctgttccacggtttcgtttgctgcttttccaagctcacttccttcccccatcgtgggcgtactgttgaacggacctggtgctctttttctctctggccggtatttagctttagaagacgtatacctcccatttagagcagcattcccaaactactcgactcgtcgaagtagtttcacagaggctaggcatccaaccgtacggggctctcaccctctatggcgtcccgttccagggaactcggaaggcatctctggccggtatttagctttagaagacgtatacctcccatttagagcagcattcccaaactactcgactcgtcgaagatctctggccggtatttagctttagaagacgtatacctcccatttagagcagcattcccaaactactcgactcgtcgaagcagtttcacagaagggaataccgtgcggctcatcattcatgaagttaatgttgtcgcaaaggcgacgcgaacgcgtcgatggcgaatggtgtatgaatgaagtttattacgcccgggaggatttacctcatagggcccagtgcttttagctacgtacacttcgacagtttttcgatgtggcttctggacttggacactgcttcattcgagtggaggagagcttgaattatgccatatgtggcacacaacaacttagctgactccggagattacattcacttgctgtgctctcgctactattatgttaaaaggggagagacaaaagcatttttctattctgttggtggcgacactgagaaagtaaccgcaaatagggcatacgccgaaaggtgcatggtgggaaagccaatacgtcgtctcgcaaattgtcatttggcaaagcgtcatttggcaaagaatagcgtatattaaagttgttgtggttaaaaagctcgtagttgaaccttgggcctggctggccggtccgcctcaccgcgaatgccaccaaagcatattcacacacaacacacgccacctaacctatactttacataacctatactcaacataacctacactcgggggcatcagtattcaattgtcagaggtgaaattcttggatttattgaagactaactactgcgaaagcatttgccaagcttccgagttccctggaacgggacgccatagagggtgagagccccgtacggttggatgcctagcctctgtgaaactccttcgacgatgcagagctacagggcatctctctggctctccagatcgctcaggagaacagaaacaggggcaacgttaggaagaaaatactgatctacacagataaccaggcagctatcaggtcggtggcaaggcccagaggccagtcaggggccacaacagtatacataagcaactggaagtcagccatagcgtgtatcaccccgctaaaattccaaccccagcgcacccaaccggagaccggtttgaagttggggtaccgggtaggcagaaaccacaaccagctaccctatacccggcgaactcaaaccaaagctgccgccgccacgcagcctcgggcagggtgagaggataatgagaggatgcattggatcgagcaatgtcttttgcgtgagagcttaacaagattacccaggcctttcggccaagggagtactcgctggctccgtcagtgtagcgcgcgtgcggcccagaacaaacttcgggataaggattggctctaagggttgggtacgttgggctttgggaggacgcctcgggagcaggcagccactaggcgggcaaccggccggaaaactggcccgggaactgaccgtggcgtgcaagagggtaaatgtgggccggtgtatttctgaagagtacccaggctcatgggaaaactggcccgggaactgaccgtggcgtgcaagagggtaaatgtgggccggtgtatttctgaagagtacccaggctcaggggagggcgtcccgcgggcgctgcagggtatgtaaaatcaaaaaagttgttaagagccgcggtaaattattgttttagagatagataactgtatttgctgttcatccaggcccttacagatcttacggaacagcaatcgaattgtcggatccacctccctttcacatataaaatcccgtattaagccgcgaagctgttgacttccttttggggtggtcatctcgatctctttcctcttaattaaaccttttctatacttattttattattttatatctaaaaataatattcttataatagatctttatttaaaagtgtggttaattgaataaataacccttttcccctaatctctctttacctcttcctactataacttagaagagaattcctcctcgatacatctaacctgatctggctcatcagcgcgttgtaatatgacgagggtgggcaaatactaaatgactcccactgtaccagtgactcatatgacagacccactacagttccccatatctccttggtgcagctaagggagcagtatgtaccttacaggggtatgattggctggacagagcaaataatccctgttatatattagattatagtagatctatataagtagatagctattcttaagatatagcttttcttctagctagtctctatcctctataagtatctatagtagtgtctcaaagattaagccatgcatgtctaagtataagcaattatacggcgaaactgcgaatggctcattatataagttatagtttatttgatagtaccttactacttggataaccgtggtaattctagagctaatacatgcttaaaatcccgacttcggacgactataaggtgagtgtttatgcataatacacaataatcctttattactacccaacatttttataatctattaatataataataaataaaagaaataaaaaaaaaagaatgaatgaaaaataatgaagaactctaacacagttatgctgacgaagtcatgattcactgaattctgcaattcacattacttatcgcatttcgctgcgttcttcatcgatgccagaaccaagagatccgttattagatgttggctgctttggaccactaaagcagtcgtacggaagagaggttgagaagctaatgcggatgcatattacctatattagcaagcttgagtttctctcttcctttcgtacagctttcttccactcctttacagaggaaaatagaataatatttacctctaagttttagtaattacttatagtataaataggtataaaatataagcttttaatagcttactatctataaagtaatggtgcactctgcctgcccaggccagcatcagttcgccccgggggataaaggctttgggaatgtggctccctcgggagtggtatagcccactgtgtaataccctggggtggactgaggttcgcgctctgcaaggatgctggcgtaatggtcatcaacgacttacagcccgcagtggccgttgcttgaagaagctctcatgaaggaattccaccaggctaggaagctaggtaggctacttactgttagctggttaagggatttaaattgtactcattccaattacaagatccaaaagaaccctgtatcagtatttattgtcactacctccccgcgtcgggattgggtaatttgcgcgcctgctgccttccttggatgtagtagccgtttctcaggctccttctccggggtcgagcagggttggtattttctcgtcttcccatccaaacgctggcactccatgactcccacaaggctcgattgacatttccccgccttaccagcacgcttagcctataggcatatcttagtaggatatattaaatagggtaatcatgaatgcttacacgctggcaaccaacttagaactggtacggacaaggggaatctgactgtctaattaaaacatagcattgcgatggccagaaagtggggttgacgcaatgtgatttctgcccagtgctctgaatgtcaaagcgaagccattcgaccaagcgcgggtaaacggcgggacactttgatttctcgtaaggtgccgcacgagtcaatttttaacatcgtccgatccctagtcggcatagtttatggttaagactacgacggtatctgatcgtcttctcagttgcgttgccgcgcaaaacccacatccaggtgccggaatattgaccggcttccctttcgccacacggcgcaaagttcgcctttgatggccaaacatggttgcaacgggtaacggagggttagggctcgaccccggagaaggagcctgagaaacggctactacatgcaaggaaggcagcaggcgcgcaaattacaccttaacctcgcgttcggttcatcccgcatcgccagttctgcttaccaaaaatggcccactagtattgatacattcgaatgtaattttaaaacgagcggggtcaaatcctttgcagacgacttagctgtgcgaaacggtcctgtaagcagtagagtagcccgttatggtttaacagatgtgccgccccagccaaactccccacctgacaatgtcttcaacccgggtcggcccgcgaaggcccttaaaaccagaagttggacgtaaatccagccccgcttcattgaataagtaaaaaaacaataggagtagtggtatttcggcggacccgtcgtggcctcctctgcgaagtagtgatattccgcatcggagagcgacgagcccctgccgttaaaccccccactttccaaggttgacctcagatcaggtaggaatacccgctgaacttaagcatatcaataagcggaggaaaagaaaccacctgctgaagcttgctacatgtttccgtcgtcgtatctccccatgtgaggatagccacgtcgtcgataaacccagtggcttttatttgtaaaaactactcagaagattccaaaataaaacaagaattaagtttcctaggcgggcgcctgatccggggcacacgcgaaagaaggtgaactatgcctgtatagggtgaagccagaggaaactctggtggaggctcgcagcggttctgacgtgcacatcgattggacctacattgcctctgtcggacgtgacgttcgtagtactttgagcagggtccccagcttcttggcctgctgttgctgtcggcgtctgacgctggtcgtgcctctgacttcgccgttgagcctctcggagactctgccgccatcaagcttattatctaatagtaataactacctttcctttctaacttaaagcttacagctataatatctgatataaatattctaatctctcagggcctggttaatacttctaataagactcttaaagtaataataactattatccgaggtaatctaatatagctatttactaactatatttattatatacccctctcaggtccagacacaatgaggattgacagattgagagctctttcttgattttgtgggtggtggtgcatggccgttcttaggtggtggagtgatttgtctgcttaattgcgataacgaacgagaccttaacctgctaactagcccgtattgctttggcagtacctgcacctcacataacctgcaccccacaggctatctcaccgcctgtagctcacgctcagtagaccggccctccctgtaacctgcacctcacataacctgcaccccacaggctatctcaccgcctgtagctcacgctcagtagaccggccctccctgtctctagccactgtcctcgacttacagcgcttcccaccctctaaaacaataatttaccgcggctcttaacaacttttttgacacctccaaactgccaactaccggcagccaagtctgtctcgttcccatcgagccatctctcgggcttgaagctcaggggatcctcaaaataatccgcattctcggagatgctagcgtgatttatgacgaaacttgttttaaaattacaatacgcgaaatactacagcacacttctagtaccgtagagtaatcgcctgctaagacgctaagccgaagcctatacgacttccttctcaaaccatacaatggagatgatagggaggacgtacgtgaaggtgttcctcggaagtgttccctcagcaaattgtctatgtgactaaaggcagggatgcgtcttccatcaagtttatcctggggatgcccttcgttaggtcttggccagcctaccctagactaagtcttagatcttggataattccttcagctttaaagataaggtatctaatatctatacttaactgatcagcttaagagcctctttcagataaactactgcaaacccgttttctaccacctaagtttcagacttggaggctgtgattagagccgaccaaagaaataaaaaaaaaagtgccagtagcttgctttgttcctcaagttcctttgcgcgaaccacgacctgtttgcctctcctatcttatcactttacataacctatactcaacataacctacactttacataacctgcacctcacatgacctacactttacataacctgccactttacataacctatactcaacataacctacactttacataacctgcacctcacatgacctacactttacataacctccacctcacataacctgcaccccacaggctatctcaccgcctgtagctcacgctcagtagaccggccctccctgtatctacactttacataacctatactcaacataacctacactttacataacctgcacctcacatgacctacactttacataacctacacctcacataacctgcacccactttacataacctatactcaacataacctacactttacataacctgcacctcacatgacctacactttacataaccttcacctcacataacctgcaccccacaggctatctcaccgcctgtagctcacgctcagtagaccggccctccctgtatctaattctcatacttgcggaggtggtcagctgctgaacttgtagcagcggcggcgaagaactcgggctggcccttcgcgtcgtacaaacgacaggcccagtaaggactcaacggaatatcgttagtatcaacctcaacgagaaagaatccatggcgcttgatccagctctttcggcccttcgaacccttccgggataaggactcttttcaaaccggtctcccgccttccacgcggatcggagggaagtgagaaggccagtatttcaaagagctcgcgaagctgattattcaatgaatcttataaaatctgaagaggaggctattgtctcgtacgtaattgagctatctacacgtgcatttccccctaggatagctagggtttaatggccggaagagcccagcacctctgctgggtctggtgcgctctcgacgtcccttgaaaatccgcgggagctagggtttaatggccggaagagcccagcacctctgctgggtctggtgcgctctcgacgtcccttgaaaatccgcggggaggaataattctcacgccaggtcgtactcataaccgcagcaggtctccaaggtgatagtgtggagatgaacaagggtatcaagtggggctcgtcttgagccaattttgcgaaactatgtgtacagtacagagtaagttgtaaccctggtcaacggaacacccccctcaacggaacacccagatgaaaatcgcgatagattcaaaaattggatgcctagcctctgtgaaactccttcgacgagtcgagtagtttgggaatgctgctctaaatgggaggtatacgtcttcctaggtataggtattaataccttaaaaactctaataataggagctatttatacagccagatatataaataacccggctgtagcccttatagccaatccttatcccgaagttacggatctattttgccgacttcccttatctacattgttctatcaaccagaggctgttggaaagcttattatctaatagtaataactatcttttctttctaacttaaagtactaattatttaattaattaattactagatcagcatccttgcagagcgcgaacctcagtccaccccagggtattacacagtgggctataacactcccgagggagccacagtcccaaagcctttatcccccggggcgaactgatgctggcctgggcaggcagagtgcaccgcggagaaccacggatgatcgtttggtggccgtgagtcgatttttttgatttcccatacaaatgaattttgcggaaaatcaaaagtggcccgggaaccgcccgtggcgtgcactttactataaataaagatatattctaagattagataatatataatctaatatatattttttaagaatataattagtagtttatagacagtcgggggcatcagtattcaattgtcagaggtgaaattcttggatttattgaagactaactactgcgaaagcatttggaaagcggccgcgtgcggtacgtcgtactgaggatgcctggtctggggagagctctgctctcgccggcgctggatgggtgctgtggatggatggccgctggctaaacttaccactgagcaacgggagatcgccacgtgcagcggacaccgccatggttgcccaataaagaccgcatgctgtaccaaatcacgcaaaagacattgctcgatccaatgcatcctctcattatcctctcacactgcccgaggctgcgtggcggcggcagatttggtttgagttcgccgggtatagggtagctggttgtggtttctgcctacccagaagttggacgtaaatccagccccgcttcattgaataagtaaaaaaacaataggagtagtggtatttcaccggcgcagaagctcccacctattctacacctcctatgtcttttcacaatgtcaaactagagtcaagctcaacagggtcttctttcctgcaaggtttacgagctagccactttcctcaagctatttagtgcactatcatgcggactttttaccgagaaagggatgagaatgagtcgaacggccatgcagtcagatattcaggaacttcttatgcatagacttgacatccgacatcaaggtaccgatatgtagcttccacctttagggaacgtgagctgggtttagaccgtcgtgagacaggttagttttaccctactgatgacctcgccgcaatggtaattgattgctttggcagtacgctggcttcttagagggactatcggctcaagccgatggaagtttgaggcaataacaggtctgtgctgcccttagatgttctgggataacaaacccgatctgcgagctcatatcccggttattcgcaagcgagccatctgtgaagatatacagcttcaagttgtgcagattgagcggtatgaagttgaggccgcggtcatggtatcttgtttctgtgtttgcagatgctcaagaagcggcacgcattgctggaatggtgggcatgttctgggcagttggcattatcgtcggcccatttattagcgctgggttcgcagaaaattcagtcacaacatggcgatgggttagttcactcagtactcatgcctcctagctagctatcttcatttaagctacttgaaatactgccagtatcagagctagatggctctacaactatctaacaagtccgtacattatgtcctgtcttaccacatataccacatcgtcgaacacgggtcttatcccgtggcttccgaccccgacccaagtgttccccacttcggtccttcaagttctcattgaagtatttgctactaccaccaagatctgcactagaggccgttcaaccctggctcacgccctaggcttcgtcactgacctccacgtccgcctactcctcagggcatcgtttctaccctgagggcgaggtatggccggaagagcccagcacctctgctgggtctggtgcgctctcgacgtcccttgaaaatccgcgggaaggaataattgtcacgccaggttgaaggcctgatctggcaaggagaagtctttcagtgcgagctatacgacaggtcgtgccgtctgaggcaatgcttcagccgccaaggatacggccacataggaacccagtgcaaggcaataagaaaatgcggctactgcgctcaagaccatgggtcccgccagggccgcctgtattggggaaatcgaggcgaaggacggcttaccctcagcagatcgtaacaacaaggctactctactccttaaataaatccaagaatttcacctctgacaattgaatactgatgcccccgactgtccctattaatcattacggcggtcctataaaccaacaaaatagaaccacacgtcctattttattattccatgctaatgtattcgagcaaaggcctgcctggagcacttgtgttgtgtgtgaatatgctttggtggcattcccagtgaggtgcatgtgctgaagtttggttcccggcgatgtgcatgggctgtggttggatttgtggtggtgcatgcacgctgtggtggaatttacagtggcgtgcattcgctgtggttggatttgttcggtatgataggaagagccgacatcgaaggatcaaaaagcgacgtcgctatgaacgcttggccgccacaagccagttatgcttatctagcccagataagggtctagaaaatccgggaaaaatcctaggatattctcagacaatctaacctatacccagtctaccctataaccagcctaccctagactaggccttagatcttgaatagttccttcagctttgtaggaatacccgctgaacttaagcatatcaataagcggaggaaaagaaaccaacagggattgccctagtaacggcgagtgatgaatataatttttaaataatttaaagcttaaatttttatatatgttcatatatttttcttttaatatttttttttctttatttatagtatataaagttatttttgctttattattagtatgtttaatttctacattacttataaatattcttcttaatcgccgcaatggtaattgagcttagtacgagaggaaccgctcattcagataattggtttttgcggctgtccgaccgggccgtgccgcgaagctaccatctgctggataatggctgaacgccttttggtttgagttcgccgggtatagggtagctggttgtggtttctgcctacccggtaccccaacttcaaaccggtctcccgccttccgtaagcgttggattgttcacccactaatagggaacgtgagctgggtttagaccgtcgtgagacaggttagttttaccctactgtttcttagctcttcggcgcttgcttaatgcctcatttgccttccgaagagtagcaacctcctcacgtaggattgccacctcatgcataacacgctgtgtaccctttggaaaggtactacatagcacacccagacactctcaccatgatcatgcaagcacccggccagttacagggcacctaccctactaatcatcagtaatttcaacgtatgatctttcatttcgctccatagaaccgtgtggcagccaataaatactaccaagatgaggtagacggtacatgacccggcttgttatgcttccgattaggatggtgtttggatttcaaatttttcaattattttggtccacggactatttctcgacccgcctgccactcactccatccattgcttctgtcaatccactttctctcgtccttcccgccctggtctccatccattcatctcttcctcgacctgtttttgtatcttatcgtacctgatgtttacttgtgcgcagagctatcaacgtccctgtttcacgggatactcgcacttcaacatcccttattcaaggaggaaagtcggaccgattagtttctaccgataaggagaaatcaggccacaattttataatttaactccggggtcgagccctaaccctccgttacccgttgcaaccatgtttggccaatacccaaacatcgaaagttgatagggaagaaatctagctctgatactggcagtatttcaagtagcttaaatgaagatagctagctaggaggcatcttgaccaggcctggctaaaaaccggccttggggagctggtctagcctaaaggtatatatctcggccaagcctagctaagatatttctaaagctagcgtttatttgatagtaccttactacttggataaccgtggtaattctagagctaatacatgcttaaaatcccgacttcggaggggcaggacagacattgtcagcccagtcagcggtggcagagacaagtgcagcagcatcagcaccggcaccagcgccagcacaagcaccagaactgaggtacagtgacccgcaggctatctatcagagatatgttgcaacaagagaagcttggtacaaggcgcagcctcgtggcagtatcaagatgcctcgtcatctaattagtgacgcgcatgaatggattaacgagattcccactgtccctatctactatctagcgaaaccacagcaactaattgtccagtgcccctcgtgggcgctggtggccaaccccggcgaacgatagttacctggttgattctgccagtagtcatatgcaacgggacgccatagagggtgagagccccgtacggttggatgcctagcctctgtgaaactccttcgacgagtcgagtagtaacgggacgccatagagggtgagagccccgtacggttggatgcctagcctctgtgaaactccttcgacgagtcgagtaggttgggaatgctgctctaaatgggaggtatacgtcttctaaagctaaataccggccagagaccgatagcgcacaagtagataattgagtttattgtacgagggataggtagaagtgatcggcccacttgtatgatcggctcacttgtggattacgttactctactatcttttatattactttaccttttttaattactaagaagatctaaaatatagaagagtagcttttaagatttcagcgcttcggcattgcgaaaatccttcctaaagatggaagtatgtcatacgatgacctcgcaaaagtcacgggccttgataggattgatacctaggaaacttaattcttgttttattttggaatcttctgagtagtttttacaaataaataaaaactttcaacaacggagctcttggttctggcatcgatgaagaacgcagcgaaatgcgataagtaatgtgaattgcagaattcagtgaatcatcgaaacgaacccgatggttcagagtccgtctgcgaagagacttgtgatttgatcttgcggaggaaaagggatatcgctccgtgaacaagaggtcaggatcagatgaagaagcgacgagaatatccatgatgggccgggtttgagtacctcgtatagccaacaagaattagactgtagcctagcccgggtgaccaacttttgtctgtaaagtcaagcccacatctggaatgtcgaccgaagtctgaagaactatgtttagccaatcatcaggcctagtcaaacctcttttctcaacttgatttctcatctgttgaccatgcatagggccgccgtatcgcctatctctttggatctgtcgccccggccggtatgtttggtggtctatttgcgacgggcattaccaagattgggcacgcccatggcctcaatgcgtggaggtaagaagacggccattagctgtaccatactcaggcacacaaaaatactgatagcagtcggcgtgtgaatcattagccttgcgcccctcggcagcaagaaccatacgaccaatatcacgaaaatagtcacgcaaagcattgggattatcataaaacgcctctacgccacgtgcagcggacaccgccatggttgaagctgtgcgctgagcactcctcttggggcgcccaagccgcaccggccctcgccacgtgcagcggacaccgccatggttgaagctgtgcgctgagcactcctcttggggcgcccaagccgcaccggcccgagtggtcttggtgtggtggaaggatgccctggggaactgagagggggaaggtggattgccgtgcgcggcgtcggtggcctttaatttatatatatatattatattctgaaactatagtttatacttctttttatagatctagataattataatattatttaattctattaaatattttcttaactccttaggtatggaagctggctacatccataaccaacatgtgttccttgccatccagaattacagctaattcatttgctatccaatatctgaataattcctcattattataagcttaaatctatattattcctaataaaaaccttctatagtagtaaatatatactatacttataaagataaattaactaataaccttatataactaacttttcttatttctaaataagtataattttagattaaactaaaataagggtttaacggcaggggctcgtcgctctccgatgcggaatatcactacttcgcagaggaggccacgacgggtccgccacgagatttaggggccggccgtccctcgcgggctttggccgatccccaacaccacgccctaggggcatgagggttgaaatgatggaataataaaataggacgtgtggttctattttgttggtttctaggaccgccgtaatgattaatagggacagtcggggtcacgatagctttacggcacgcccagaagaaactcatcgaggcctcttcgtattctcgctgtacttctgggcgcgcatcacggatggatctttacaatatatttattacggttgggcctcagattttatgtggaatgcccgagagctgatgaatcaggctgagatgtgctgctaccccattagcgctcccggaaaagctcagcttggaagctcggatgcttgtgcttggagatcttagttgcattggaggttagatgagccaaacgacgcattaacatagtattatatcgtctatgagctcctcagctcccgaaccataccgaccgcggtcttgcttgcctctgcggcctcttttgcggcaatctttgcatctctagcagcatcggtattatcttgcatcgtttgttgaatgactcctgtgatctgctttaacccagcatcaattcgattgagggagtgaccactcagtgggaatctgcaagatacggtacagttgaagagatttcccacagcggatcggaccagcttgttacagttccagagaccgatagcgcacaagtagagtgatcgaaagatgaaaagcactttgaaaagagggttaaaaagtacgtgaaattgttttaagaatataattagcagtctatacctgaacctttaatactataagataaagttaaatattatactttcagcctgggtataggtattaataccttaaaaaattcatttgtatgggaaatcaaaaaaatcgactcacggccaccaaaccgcgcgaccgatatacatgacttttgtaaccccgccatcccatctcttctaagctaccctgaaggctatatcgcctaagatactggagaaggagatgtgcgggatgtaatgcccttagcaggcttcggccgtccggcgtacggttaacaaccaacttagaactggtacggacaaggggaatctgactggctaattaaaacatagcattgcgatggccagaaagtggtgttgacgcaatgtgatttctgcccagtggaagcatttgatcataaattcatcggttgtatgacttccgtggccatcaaggataagcaacctaggtctcttagtctcaggcttcgtcaacgggataaagatcaggtctagccatacaagagcgatctcgtcattcgtccagcccgttgcagaagctgtaaaaaaccacttcttatatagctcgagttcaagaggaagaggaaagagatcgagatgaccaccccaaaaggaagtcaacagcttcgcggcttaatacgggattttatatgtgaaaaggaggtggatccgacaattcgttaaccgcagcgggtttgggttgggttctgagttcggggggcaagtgcaggtatcagaacatttgctgtgcgatggtagtcggcactatccacaatgcctggcacgacgcttcaaaggtcggtttagaataccgcctaaaataaaagtaacctatatctaggatagcaaaggttaaataatattatgtttcgaatccatgcgacatggctacatgtcacgtgggatacccaagggacgtctagagcgcaccagacccagcagaggtgctgggctcttccggccattaaaccctagctccggacaaaccgatttcagggtggtgcgcctttgaaacggaacttccctatggcttaggatcgactaacccacgtccaaccgctgttcacatggaacctttcccctcgagcaatgtcttttgcgtgatttggtacagcatgcggtctttattgggcgtggtttgtcactttttggaattttcgactcgagcaatgtcttttgcgtgatttggtacagcatgcggtctttattgggcgtggtttgtcactttttggaattttcgagcagaaaatggaaaggtactacatagcacacccacactttttggaattttcgaccagaaaatggaaaggtactacatagcacacccagacactctcaccatgatcatgcaagcacccggccaaaaagtcatttatatcggtcgcgcggtttggtggccgtgagtcgatttttttgatttcccatacaaatgaattttgcggaaaatcaaaagatctcccgttgctcagtggtaagtttagccagcggccatccatccacagaacccatccagcgccggcgagagcagagccctccccagaccaggcatcctcagtacgacgtaccgcacgcggccgctttcgtgagggtcgacgcccactatgaatcaccgatctcccgttgctcagtggtaagtttagccagcggccatccatccacagaacccatccagcgccggcgagagcagagcgctccccagaccaggcatcctcagtacgacgtaccgcacgcggccgctttcgtgagggtcgacgcccactatgaatcaccaccaatgcccttcggggctctctggtgattcatgataacttctcgaatcgcatggccttgcgccggcgatggttcattcacccaacccttagagccaatccttatcccgaagttacggatctattttgccgacttcccttatctacattgttctatcaaccagtcttcttcatcctcatccaatgaactcgatccctagccgctgctcgaagcacccgacgaacgcgctgcactcggagattcgcaaatgcttcacctttcagctcagagctgccctcgcttctcgccccagagctaccctcgcttgccttcacctttggtttctcaacctgctggccatacttcacccgcctctcagctcagagctaccctcgcttgccttcacgtttcgcgcctttggtttctgaacctgctggccatacttcacccgcctctcagctcagagctctactagaaggttcgattagtctttcgcccccatgcccatatttgacgatcgatttgcacgtcagaaccgctgcgagcccccaccagagtttcctctggcttctataggctgaacctaccttagacccagcttaccctacagctggtctaccctatgctggaggccttgacctttcaaaaaatatagtgcaaaatatagcgcaaaagaatcttatttttgtgagagagaccagaaaattctatctaatttctctcatagctgagcgtgagctacaggcggtgagatagcctgtggggtgcaggttatgtgaggtgcaggttatgtaaagtgtaggtcaggtgaggtgcaggttatgtaaagtgtaggttatgttgagtataggttatgtaaagtgtaggttatgttgagtataggttaacaaaccgatttcagggtgatagaccgttaagaagaaaagagaactctgcctggggcccccgccgtcgtctccgcgttcaacaaaccgatttcagggtgatagaccgttaagaagaaaagagaactctgcctggggcccccgccgtcgtctccgcgttccgttgcgttgccgcgcaaaacccacatccaggtgccggaatattgaccggcttccctttcgccacacggcgcaaagtgcggagaatcgacttccacagatatgcaaggggcccgtccccaagataaggatcacaacccctgcatttgaccgaagagtacagaaaagatgaaatcagactaccctgaaccaaagatatatatccatcctcggtattgctacccgatcttcgggacttgatttgatccttattgatgtcatagtccgccacgagtgctccaatacgggggctcggagccgacagctcacgataagttaaaggtgagcccttccctcagacatccccgccttctgtataatcttcctacagtttttgagagagatatgtcgtttgttagtctgccaaacgaattacttctctatatcagacccgcagtctagctcagaaccaaccccctttgaccgcagctggtgaggatgcctcggctggcctggagtcacctttacatgtagctgcgcctatcaatcccaacaacgatgatagggaaacaatcagaattgaccatgattcgggtatgattatgaccgacataatggtgtctcagtgggaatctgcaagatacggtacagttgaagagatttcccacagcggatcggaccagcttgttacagttgacccgctctggtggaggctcgcagcggttctgacgtgcaaatcgatcgtcaaatatgggcatgggggcgaaagactaatcgaacctaggcagagtgcaccgcggagaaccacggatgatcaacctgcccaagtctggtcatgaacgcttccctttcaacaatttcccgtactttttaaccctcttttcaaagtgcttttcatctttcgatcactctacttgtgcgctatcggtctctggccggtaccgtcgtgagacaggttagttttaccctactgatgacctcgccgcaatggtaattgagcttagtacgagaggaaccgctcattggttcattcaaatttcttccctatcaactttcgatgtttgggtattggccaaacatggttgcaacgggtaacggagggtgaatgtaggtcaatacggacgacgatatacaatacgtcggataagaggcgatgttaccatactgtttgctgcgctacaccttagctgtcgctcacacagtgcatcgtgttaattactcctctatttaatattattttattaggtaatctatagtaactaactatatattatagaaactagtatataagattttctatagagcttttcccaaaatggaatacatcaggcttcaaatccttcagtatgagtttcacacaaaccagatgtaactaaattctaactacgctcttaatgccagtatcactgttgagggtaaccgacatcgccaggcaaccagggcggctttcgcgttcttagcaaagataaaaggagagcctccctagagtcgtatatgccctcgggcgggagtacatcatcaggaaatgttgcctgagccatgatagggctgatctctgcggttgtgttgtgactggagttgtaagccgcaggctccacccctggtggtgcccttccgtcaatttctttaagtttcagccttgcgaccatactccccctggagcgatgagtggagctagtacgcattggtctcttgtacttgtgtaggcaggacatgacatgccattgtatttatcggttctacgcacgcgcgaagatgtgagagcgtcaatacccatgtctgaacctgaagaggagacattgcttggcgtataatcacaaccagctgattattctgaccaccacttcaaaaaaagtcatgtatatcggtcgcgcggtttggtggccgtgagtcgattttttgatttcccatacaaatgaattttgcggaaaatcaaaaggcatgttcatgccaggctggagcatgacgaaggcacagagcgaagtcaacaggcagtaggcgccacggttctgctccacgtaaagcacctgctgttccacagagttacggtcgaggatcggtagctgggggtataggttgtcgaagaagaaggcgatggacgctgcgacgccaatagtagccgcatattcaaatggcatgctagcagggagcctggtggagaatgactcttctacaaccagatattccgcaaatgctccctgctcttgtagattgcccgggaggaatcctcccactcctactggagatttctgttctccatgagccccccttaggacacctgcgttatggtttaacagatgtgccgccccagccaagctccccacctgacaatgtcttcaacccgggtcggcccgcgaaggaccttaaaaccagaagttggacgtaaatccagcccccacagggataactggcttgtggcggccaagcgttcatagcgacgtcgctttttgatccttcgatgtcggctcttcctagcataccgattgaagactaactactgcgaaagcatttgccaaggatgttttcattaatcaggaacgaaagttaggggatcgaagacgagcagataccgtcgtagtcttaaccataaactatgccgactagggatcggacgatgttaaaaattgactcgttcggcaccttcgctattctcgcatccttcatccttgtttcaggtctgattacttcgttcttaacgcaatccaccattacctatgaatcgaggtccgtcttgaagcataccgaagtaccatctgccccttttgcccaatccttcccaccaaggctcaaaggcttgttctgacctacagagtcaaacaccttgtgaggcaggtgcggcagccacgagaggaaatagccggcttcagctacagcccagattttactattaaactatatttctaataatactaatactaggagaaagaactataatatatatataaagaaaaagtactttctctaattagtaatagagataataataatttagaggagttagaaataatttctattaataaaaagaaatagagtataatagataaagaactaattatattaatattaataactaaagttaagaaataaataaagaagttctaataatacttatttaaaagtataatataattaaataccttagaaaaacttcttttctatatattaataaatataaactaatataagtaattaaaaaaataaattaactagataaaaaataatttaaactatttataatagagctatagtataatataatattaataatagattaaaaaactttagaaataatagaagctagaagctctatttatattcttatagaaataaaaattaaaagaaactagcttatagtatttattaactatagaatataagaaaattatattttattagtagtaattaattaactctatttactatagagaaaaaagaaagaaatctatatagtaactaatataaagagcttaaaatttaaatataataatagaattattaatttaaatattaattattttataattaaaggggaatgccgaaacttcacgaaatgttactattgcacctgctggcgctatgggcgtatgaaatgtgggcattgggaccgaagctcttgtttgggccaccaccttcacccgcactggcctttgccgatgtcccccagcttgcctgtgggtcaacttgggtcgtagctgacatggcgggccggacggccgaagcctgctaagggcatcagcacccaggtgctggctgccgccggccggttgcccggctagtggctgccttctcccgaggcgtcctcccaaagcccaacgtacccaacccttagagccaatccttatcccgaagttacggatctattttgtgcagaataaggtggatgctagtgttctacagacagccgacctatggtgcactagcttgctttttgcgtcaagtttcgtctttattaaattctaattaattctagaatttagatttatagctatagtttatatatattagtaatagttagattaattcttatactaagttccctggaacgggacgccatagagggtgagagccccgtacggttggatgcctagcctctgtgaaactccttcgacgaggtcatctaatgatagtgcaaatttcgggctttctcatccatgagacgcattggccgaagaaacggagtcgctgacaataccttcattttcggtgctaagcttagtcccgagtaaatatagaatgcgtgagctcgagcccatttctgcgtcaaggtctccgtagaagttcacaaggcagttgtcgttcgaagatgcgttgtctgagatcactattccgactcgatcctctatcttccattcacgcacaactcgcccaagcgtcaccgccagattttccccgctgtgacacccgggactttgaccggtccgggaaatggctgccagcagttgcaacgaccgctgcaagtgcatcattcgtgcaggaaactgctcacggaaggccaatgaatgaggcaaaggaggacaacctacttgctgcaagactgttaattcgtctgatctcgacgtcataatcctccattaggcactcgtgtaaggtccggaacggcttccaatttggctggccatgcttctgcagtaagaaggtgttcgtgagagcggtcttaagaaggaagccccacgccaatgcccgccaaggtcccttaataacccggtgatccaatccctcttgctgccgtagctgagaagagtccttatcccggaagggttcgaagggccgaaagagctggatcaagcgccatggattctttctcgttgaggttggcactaacgatattccgttgagtccttactgggcctgtcgtttgtgcgacgcgaagggccagcccgagttcttctccgccgctgctacaagttcagcagctgaccacctccgcaagtatgagaatacgatgtcgcgagcttgagcattattaaccacatgtaggtctcacaggatcttcgagagcagtcaaggtgccgatacagacccgctcaacctctgagcttctcgagctttatatatatcactaggaaatctaatttccttatttttatttttttttaatactactataaaaccagccccgcttcattgaataagtaaaaaaacaataggagtagtggtatttcaccggcgccgaagctcccacctattctccacctcctatgtcttttcacaatgtcaaactagagtcaagctcaacagggtcttctttccccgctgattctgccaagccggggccggccgtccctcgcgggctttggccgatccccaacaccacgccctaggggcatgagggttgaaatgacgctcagacaggcgccagtctatctttacatcccgcacatctccttctccagtatcttaggcgatatagccttcagggtagcttagaagagaggggatggcgggtttacaaaagtcatgtatatcggtcgcgcggtttggtggccgtgagtcgatttttttgatttcccatatgtcgaagtgtacgtagctaaaagcactgggccctatgaggtaaatcctcccgggcgtaataaacttcattcattcattggtccccgtggcatggccgggtccctggggttgaaccaacgctttgtggagaccgtgaagaacctcgttggcgaggatcagttccaaatggccggaagagcccagcacctctgctgggtctggtgcgctctcgacgtcccttgaaaatccgcgggaaggaataatgctcacgccaggtcgtactcataaccgcagcaggtctccaaggtgaacagcctctggttgatagaacaatgtagataaggccctcgcttgccttcacgtttcgcgcctttggtttctgaacctgctggccatacttcacccgcctctcagctcagagctgccctcgcttctcgccccagagctaccctcgcttgccttcacctttggtttctcaacctgctggccatccatctcccaaaccccctacgcagccagccaccagggccgcctgtattggggaaatcgaggcgaaggacggcttaccctcactcccttaagctatatactacctctaactatatactaactctaaatactctctaactctaaccctaagtaaccctaatactccctccccccagcttcaaaaatcatatattggactgacgatgtggctgtctgaccaaattgaccggaacttttgtcgacccactgtagtacatcacgggaaaccgcagggagcaatagggtagatggaaaagcacaatcgaggaacaggcgcattatgggctcgaggagacctatttagaccggccctccctgtatctagccactgtcctcgacttacagcgcttcccaccctctaaaacaataatttaccgcggcggacataagcatgctggcgtttacgcaaggatccagctgccgacgtcttctgctagacgaggtgatggatgggtcagggccagggccatgcgaggcaggtgaggcagcgtggggtatgtcagttggtatggagggcgaaatgcctggtgttgcctggcttcagggatttcagggatcgaaattgtcttatattcattggaagagcgaaaggccaaccaagggcgaggagtatcccgaagttacggatctattttgccgacttcccttatctacattgttctatcaaccagaggctgttcaccttggagccctgctgcggttatgagtacgacctggcgtgagaattattccttcccgcggattttcaagggacgtcgagagcgcaccatatcccgaagttacggatctattttgccgacttcccttatctacattgttctatcaaccagaggctgttcaccttggaggcctgctgcggttatgagtacgacctggcgtgagaattattccttcccgcggattttcaagggacgtcgagagcgcaccagcggcagggccaccgacgccgcgcacggcaatccaccttccccctctcagttccccagggcatccttccaccacaccaaggcggcagggccaccgacgccgcgcacggcaatccaccttccccctctcagttccccagggcatccttccaccacaccaaaaccacgacagaccgggcgccagaactctggcgtccttgtaatccatctcccaaaccccctacgcagccagccaccagggccgccggtattggggaaatcgaggcgaaggacggcttaccctcagcagatcgtaacaacaaggctactctactgcttacaggacccatggcttaatctttgagacaagcatatgactactggcagaatcaaccaggtaactatcgttcgccggggttggccaccagcgcatggcttaatctttgagacaagcatatgactactggcagaatcaaccaggtaactatcgttcgccggggttggccacccgcgcccacgaggggcactggagaattagttactgaatggcactcgtgagagcgcgccgaacacagcaccagcggcagggaccggccctagtggtcttggtgtggtggaaggatgccctggggaactgagagggggaaggtggattgccgtgcgcggcggcggtggccctgccgctggtgctgtgttcggcgcgctctcacgagtgccattcagtaactaattctccagtgcccctcgtaggaggcagagaagctacaggtgcaggtgatggagactcgtaagacgaagcttggagcagaccatcccgatacactgacaaaagtcctagcggtgatcccgagccgccaaactagagatgtgcgatgttgagtggcctacgttgcattatggtctacgattgccattctgggagttcgcccatcttctccaattacaatccgaattatgagatttcgccagcccgttgttttctgcacattatccccgcctcctccacacacacagccctgtgtgagctcacagagagccgctgagcccccggcactggagcacacttctgccggcggtttctcctatggtaggcctaccacggatgcccctctacctgcctcattgtcgcctcaaccatctgatatggggttgccgtttatctgaaagaggctcttaagctgatcagttgagtatagatattggatatcttatctttaaagctgaaggaattatctaagatctaagacttagtctagggtaggctggctatagggtagcctgatattgaagtgccagccactctgcattagctggccaacgtaagcgctcagccgcacatggctggttaggcagcaataaaaccctcaggcatttcgtagatctcgtagatttgctcaacccttaaatccatttcctcgttaataaagaatttatagctattatatatatatttaaagaatttaaatactactacttagggataatatataaggttaagatatataaacgcaactgaacgcggagacgacggcgggggccccaggcagagttctcttttcttcttaacggtctatcaccctgaaagcggtttgtccggagctagggtttaatggccggaagagcccagcacctctgctgggtctggtgcgctctcgacgtcccttaacgcaactgaacgcggagacgacggcgggggccccaggcagagttctcttttcttcttaacggtctatcaccctgaaaccggtttgtccggagctagggtttaatggccggaagaaacctgcacctcacataacctgcaccccacaggctatctcaccgcctgtagctcacgctcagtagaccggccctccctgtttgcctcaaacttccatcggcttgagccgatagtccctctaagaagccagcgtactgccaaagcaatacgggctagttaccaggaatccaacgcttaccgaattctgcttcggtatgataggaagagccgacatcgaaggatcaaaaagcgacgtcgctatgaacacataatcaaccacagcgcacccacaccaccacaaatccaaccacagcgaatgcacgccactgtaaattccaccacagcttaatctttgaacgcacattgcgcccgccagtattctggcgggcatgcctgtctgagcgtcatttcaaccctcatgcccctaggaatctttgaacgcacattgcgcccgccagtattctggcgggcatgcctgtctgagcgtcatttcaaccctcatgcccctcgggcgtggtgttggggatcggccaaagcccgcgagggacggccggcccctaaatctagtggcggacccgtcgtggcctctggtgacgcccccgccccaggtggatcctgtacgaaggggagatcccccggcaaccccatatcagatggttgaggcgacaatgaggcgtcatctgtcatctggctataaagggccctctggaggctggctgtgccctggaggcgttagttgtgccttcaggctatggctaattaatgcaggctagtaacacgatgcactgtgtgagcgacagctaaggtgtagcgcagcaaacagtatggtaacaccttggaaggatcgcttcgtcatctatctcgttaaccgtcatcgtcacctaggtcatgtgaccacatcgatcgtggagtcactccacggtcagatgaagcgtttcctttggtcttcgaaggcagattttgatacgatcatagatcgcttcaacgaattctggaaacatcaaattgagaatattcggaatctccaagcgatacagattcatattgtaattttaaaacgagcggggtcaaatcctttgcagacgacttagctgtgcgaaacggtcctgtaagcagtagaggagccttgttgttacgatctgctgagggtaagccgtccttcgcctcgatttccccaatacaggcggccctggtggctggcagttgaatcataggtttgggcatctccagttgccaaggtatagtgtaatccggccactagtaaagtgtcttggagggcacctgaggtctgaatgatggatgggaggctacaagcccagttaacataagatgtctacaaattacaactcgggcttgcgccagatttcaaatttgagctgttgccgcttcactcgccgttactagggcaatcgctgttggtttcttttcctccgcttattgatatgcttaagttcagcgggtattcctacctgatctgaggtcaaccttggaaaaagagggttaaaaagtacgtgaaattgttgaaagggaagcgttcatgaccagacttgggcaggttgatcatccgtgggtctccgcggtgcactctgcctgcccaggccagcatcagttcgccccgggggataaaggctttgggaatgtggctccctcaacgggccattgagcagggcgagggcaaggacgacgaagaggcacaagggagcgggggtgagaatggcacagaggcatatgagggcgaggttgaagacgacacagaggcatgtgagagcgagagcgtaagcgaggatgagggggttgaggctgaggagagcgagtatgggaacggtgatgagagtgaggatgactttatataactaacttttcttatttctaaataagtataattttagattaaactaaaataaactctaatatactaatattagaatactattatattctattctaattattagttctttagattttaatagtttaataatataattaaagaatattaattactatagttattctaatactaaaaccctgagaaacggctactacatccaaggaaggcagcaggcgcgcaaattacccaatcccgactcggggaggtagtgacaagaaatactgatacagggttcttttggatcttgtaattggaatgagtacaatttaaatcccttaacgaggaacaattggagcccgttgctcagtggtaagtttagccagcggccatccatccacagaacccatccagcgccggcgagagcagagctctccccagatgcctgtatagggtgaagccagaggaaactctggtggaggctcgcagcggttctgacgtgcaaatcgatcgtcaaataggggcatggacgtaatcaacgcaagctgatgacttgcgcttactagggattcctcgttgaagagcaataattgcaatgctctatccccagcacgagatgaccttccttcagtgttatacaaaggctcgattgatcggtctaacagatacgaatattcgctcgggctggaaggggtccggcttgtggcctgttaacagtatacataagcaactggaagtcagccatagcgtgtatcaccccgctaaaattccaaccccagcgcacccaacccaaacagtatacataagcaactggaagtcagccatagcgtgtatcaccccgctaaaattccaaccccagcgcacccaaccccctacataatcaaccacagcgcacccacaccaccacaaatccaaccacagcgaatgcacgccactgtaaattccaccacacaatcctaccggctagggttgctcgagccgataggtcagggctctgacgatcgggtccagttaggttgtaaccttccaatctagccaactgacccctctcagtgaaactgatccttctaggtctgttgtatcgtagccgcggctatcgtgtgattgaacagaccgttggaatatggatgaagccggcattatggagggagtcagaggcaacgggctggtgctaggatcgtcaaggaagcaatacaccctcctgaagcagtcaggataagttgggtgtttaacggcaggggctcgtcgctctccgatgcggaatatcactacttcgcagaggaggccacgacgggtccgccactactcggaaggcacgtcgccagaaacatcctctacaaattacaactcgggcttgcgccagatttcaaatttgagctgttgcggtaacataagatggatagctaaactcatatccgtgcaggacttacatatccatttccccttgaagatagatactaaattcatcttgcaaacaaagccttgcgagccttccttcgcgatgagaaccgccgtaagtggctacaacgcaaaagaccgcttcttcttccagagcatacagctaagcgtcttgcctgggcggaacagtataaggatattgactggaactgtgttatctggagcgatgaatgcggtgtgctcctgtcagacttcatgggacactcgcgggacccatggtcttgagcgcagtagccgcattttcttattgccttgcactgggttcctatgtggccgtatccttggccgcgtacgcgtaggaggatattggccatttcctcaacactacgtatcctaggaggaaacgcacgtgtagatagctcaatgacgtacgagacaataacatcctcctcggcgatgtgcatgtgctgtggttggatttgtggtggtgcatgcacgctgtggtggaatttacagtggcgtgcattcgcggtggttggatttgtggtggtgtgggtgcgctgtggttgattatgtagggaatattgaccggcttccctttcgccacacggcgcaaagtgcgcctttgaaacggaacttccctatggcttaggatcgcctaacccacgtccaaccgctgttcacatggaacctttccccacttcggtccttcaagttctcattgaagtatttgctactattaatatcttaaaaactctaataataggagctatttatatagctagatatataaataatctagctatagctatagcctctaagaggggaagcttattatctaatagtaataactacctttcctttctaacttaaagcttatagctataatatctaatatagggaaaagcgtattcgaaaccattggggtacttctcagccgggggatatgaagccaatccacccaatcgcacagttcatgagccatgagacctttgaacagctttatcgtgcgtttcggccgtatgacccgaggggctcctacgaaggctcttttgtgcgtttcctctttgtagacctgcgtgatttttcacaagctacatttacgctagtctccttatattcgcggctcctcggtgaataatcgagcaattcttcacgaaaggtctctgtgctgctcccttttcgctcactgaaagattgtatgggaaatcaaaaaaatcgactcacggccaccaaaccgcgcgaccgatatacatgacttttgtaaacccgccatcacatctcttctaagctaccctgaaggctatatcgcctaagatactggagaaggagatgtgcgggatgtaaagatagactggcactccattgaatagtattagaggtaccttcaatctacagaccgtcgattagaagggatagatgggtgtgggtggatgtggcctatgctttgaatgcagggttgatgtttggttctttgtcgctgcttgggcgtagctcgaaataggcgatgtctaatatcctaagatcaggtaatatataatctgatatatattttttaagaatataattagcagtctatacctgaacctttaatactataagataaagttaaaatataagcttttaatagcttactatctataaagtaatagttaaatagaatatttaaattaaactctggaataatacttataagtatatattaactattcctaaaaacagagcgagtcagctcaagcgctttcaagaagtgaagaccagtaaagtaggcatacatcgtgtaatataacacctttgagtcgacagtgccggcattgggaatcaggctcccgtctagcagatccaagacgtcactacagattgtctcgagattctgacttagaggcgttcagccattatccagcagatggtagcttcgcggcactgcccggtcggacagccgcaaaaaccccccaatgattactccccttcaacccccaaatctcgacccgcctgccactcactccatccattgcttctgtcaatccactttctctcgtccttcccgccctggtctccatgtctacagtagagtcaatagcaaggccacgacgcaatggagaaagacggagagcgccaacggcgtccatctcgaaggagtcgccagcgataacacgcttggccgccacaagccagttatccctgtggtaacttttctggcacctctagcttcacacgtcgaaggactaaaggctcgataggccacactttcatggtttgtattcacactgaaaatcaaaatcaaggggacttttacccttttgttctactggccgtcagttcccaatgatcccgatggcttgcccgatccatcatcacactgtcccgagccgcgacctggcaaggagctttccattgactttcgtggatataggtcatactgttgtgggttgttttagtagggtaggtgccctgtaactggccgggtgcttgcatgatcatggtgagagtgtctgtgtgtgctatgtagtacctttccattttctggtcgaaaattccaaaaagtgacaaaccacgcccaataaagaccgcatgcattccacgtcttcattgataacctatttacctctgctgacctctgccgtgctctgcgagagagaggtcacggaacaacaggcacatgccgctcgttttaaaattacaatacgcgaaatactacagcacacttctagtaccgtagagtaatcgcctgctaagacgctacgccgaagcctattcttgtccatctgtacgtgcgggtggtatcaccgctttctggcatggattctgacttagaggcgttcaggttcttgacggagtagatgccggcgacattaatacagagcatagtaagaactgaagacgattcttggtcgaattctaccagtttctcaaaggttactatcgctttgttctgctagcaatggctcaagccccgatgtcatcggcaaccccacagaccccgccttcccgaaagcgccctcgggacgacgcacaaccagggggacttctgactccgccagccacgaggtggtcttggcaatacttcaaactacctttgttattctaattcttagtatgctaggagaggtttatcttgatatggaactgctctatgctaatgactgacagctctctaaattcattagaggcatgcctggcttcagggatttcagggatcgaaattgtcttatattcattggaagagcgaaaggccaaccaagggcgaggagtcgatgtggcttctggacttgaggaaactctggtggaggctcgcagcggttctgacgtgcaaatcgatcgtcaaatatgggcatgggggcgaaagactaagcgaaccttctagtagctggtttccgccgaagtttccctcaggatagcagtattgaactcagttttatgaggtaaagcgacctaacctatacccaggctaccctataaccagcctaccctagactaggtcttagatcttgaataattccttcagctttacagataagatattcaatatctatacttaactgatcagcttgagagtctcttttagataaaagtgggtcttataaaagctatatatatcggtcgaaggttttggtggttgtgagttgatttacatgtgaacatacctactgttgcttcggcgggattgccccgggcgcctcgtgtgccccggatcaggcgcccgcctaggagctggcctgggcaggcagagtgcaccgcggagaaccacggatgatcaacctgcccaagtctggtcatgaacgcttccctgtctacagggagggccggtctactgagcgtgagctacaggcggtgagatagcctgtggggtgcaggttatgtgaggtgcagggtatgtaaagtgtaggtcatgtgaggtgcaggttatgtaaagtgtaggttatgttgagtataggttatgtaaagtgtaggttggattgttcacccactaatagggaacgtgagctgggtttagaccgtcgtgagacaggttagttttaccctactgatgatttccgcaaaattcatttgtatgggaaatcaaaaaaatcgactcacggccaccaaaccgcgcgaccgatatacatgacttgcgacgaaggaacgaatccggctgcgagagagctctccctagtctctctagccgctctttcgctgaaggccgagtcacctcaccagcaaagacgattagcctccagaggccatccgatttccatggataggctggttcgcagcaccgatatgtcccgtgagactgattttgggtggaggatgggggagtcgattccctgcaaaccatccattccggtgaaaaaattagagtgctccaggcaggcctttgctcgaatacattagcatggaataataaaataggacgtgtggttctatgttgttggtttctaggaccgccgtaatgattaatagggacagtcgggggcatcagtattcaattgtcagaggtgaaattcttctagttatttttatttcttaagtattatattaaaataaaaagtttaacctttactatacttattaaactatattatcataggaaaaaatagtataataatatatttttatataaaaagtggggtaaaatcaagatataaggtttttcccctactctctcagggtagaaacgatgccctgaggagtaggcggacgtggaggtcagtgacgaagcctagggcgtgagcccgggttgagcggcctctagtgcagatcccagacttgggcaggttgatcatccgtggttctccgcggtgcactctgcctgcccaggccagcatcagttcgccccgggtggaccagacttgggcaggttgatcatccgtggttctccgcggtgcactctgcctgcccaggccagcatcagttcgccccgcgggcccgggaactgaccgtggcgtgcaagagggtaaatgtgggccggtgtatttctgaagagtacccaggctcatgggagggcgggggaaagaagaccctgttgagcttgactctagtttgacattgtgaaaagacataggaggtgtagaataggtgggagcttcttgggtcaaatggaataaggcctgcacctctaaaagcgccctggatagtttgttccgtcattgcagctttaaatgcggttaaaaaacgcgggtaggaagtccgccttcgttatgtgtgtaatccccgctctcattatcccttcaatttctttaccataggaattgttgaaagggaagcgttcatgaccagacttgggcaggttgatcatccgtggttctccgcggtgcactctgcctgcgcaggccagcatcagttcgccccgggggataaaggctttgggaatgtggctccctcgggagtgttatagcccactgtgtataggaagagccgacatcgaaggatcaaaaagcgacgtcgctatgaacgcttggccgccacaagccagttatccctgtgggaacttttctggcacctctagcttcacacgtcgaaggactaaaggatcgataggccacactttcatggtttgtattcacaccagtatcttaggcgatatagccttcagggtagcttagaagagatgggatggcgggtttacaaaagtcatgtatatcggtgaaaatggatggcgctcaagcgtctcacccatacctcgccctcagggtagaaacgatgccctgaggagtaggcggacgtggaggtaaaaaatgcgacgaagagaagccgatctgccgcaggtgtagggaaggtggttggaagtgtgatggatacgcctatgtagctagcaccactgctggcagcgccgtacttcctggaaactttagcagtagaaggggcagcttcgatagcagtagaagaagcaatagcacgtcttctaggaaacttgccgtcagacagtcggcatcatcctgcgctaacgctaagagtatagctagaatacctatagcatccgtcgccagcggtagcgccagcatcttcagttcctctcctccttccacctccaattcctgctgacgggtccgccactagatttaggggccggccgtccctcgcgggctttggccgatccccaacaccacgccctaggggcaggagggttgaaatgacgctcagacaggcatgcccgccagaatactggcgggcgcaatgtgcgttcaaagattcgatgattttgcggaaaatcaaaactggcccgggaactgaccgtggcgtgcaagagggtaaatgtgggccggtgtatttctgaagagtacatcctctacaaattacaactcgggcttgcgccagatttcaaatttgagctgttgccgcttcactcgccgttactaggccaatcccaacatcaggatcggtcggagatgcgccgaagctctctcctacgttcactttcattacgcgtaggggtttgacacccgaactatatagcccccgggtccctaatcattcgctttacctcataaaactgagttcaatactgctatcctgagggaaacttcgtcggaaaccagctactagaaggttcgattagtctttcgcccccatgcccatatttgacgatcgatttgcacgtcagaaccgcggaggctggacgctgaactcattgtcatcgttctggaagtagaagtggcaaagccggcaaaccgatttgctggttgctatgaacatattcccatcccaaaaatccgatggcttgacctttctcaccgtggtaagatagtcgtgcatatggacctctgcagctgctaggctgcttacctaagcagggttcggccaacagctggctgatccctgccaggacccttttgaccacaacaaatatcttatctttatacttaattaccctaaccctataatttaactaactactcctaaccctataatttaactacctccccctaactataatttaactactttccctaactatatacttagaaactccccctaactataaattaaaaactccccctaactataaattaaaaactccccctaatcataaccgcagcaggtctccaaggtgaacagcctctggttgatagaacaatgtagataagggaagtcggcaaaatagatccgggctccgtcagtgtagcgcgcgtgcggcccagaacatctaagggcatcacagacctgttattgcctcaaacttccatcggctttccaccccagggtattacacagtgggctataacactcccgagggagccacattcccaaagcctttatcccccggggcgaaaaaagtcatgtatatcggtcgcgcggtttggtggccgtgagtcgatttttttgatttcccatacaaatgaatgttgcggaaaatcaaaaaatggcccactagtattgatacattcgaatgctcacgttcaattaagcaacaagagcttcttacatatttaaagtttgacaatggatgaaggcaatatatagcccccgggtccctaatcattcgctttacctcataaaactgagttcaatactgctatcaatggcccactagtattgatacattcgaatgctcacgttcaattaagcaacaagagcttcttacatatttaaagtttgataatggatgaaggcaatatatagcccccgggtccctaatcattcgctttacctcataaaactgagttcaatactgctatctccaaccacagcgaatgcacgccactgtaaattccaccacagcgtgcatgcaccaccacaaatccaaccacagcacatgccctctgaggtagtaaccaccattccagggaagataacccccatcataaagccggtctcgtcaaagttgtataggtcctcatctaggatgaactctggcgtccttgtaatccatctcccaaaccccctacgcagccagccaccagggccgcctgtattggggaaatcgaggagaaataatcgtgcaaagagccatcttggagtagatgtatatcggtgtacgccagtactgctggaagacgcgcttgaggctctcgcggagttggacgatgaatggagcagcaaattcttggtagctgcctggatcctctttgcggggactcgaaccataaagtagagtgatcgaaagatgaaaagcactttgaaaagagggttaaaaagtacgtgaaattgttgaaagggaagcgttcatgtcttggcgatacttctcttcttggcgatacttctcttcttggcgatacttctcttcttggcgatacttctcttcttggcgatacttctcttcttggcctatactaacctgggatcatttgatcaactggtatagggtaacctgatctaccctatagtctatagggtaaatctcaacagatatagtagttatagtgttggtatactaaatacctccaactagcagtcacggcctggaagcctgttacagagcggtccgcttagtcacgacactgagagggggaaggtggattgccgtgcgcggcgtcggtggccctgccgctggtgctgtgttcggcgcgctctcacgagaggttgcagcagctggagtagacgccttcttgggtgatgccgagcttgttgcagggcacgtaggtctcgttgtcggccagtgtcttgccatctggtgcgaaacagtttacttcgtcggccgagacagagacgggtagagaactggctgccatcagcagctggacgatgatcgaatggaacatggtagcagtcagctaagctcatttagaatcagaacttagtatactatattaggctctctatatatatacaagagtgaaggggagaaaaggtatataacctccccttctgccattgattcaggcttttaattttctaccatcaatcatcaaatatcttcagaaatacaccggcccacatttaccctcttgcacgccacggtcagttcccgggccagttttgattttccgcaaaactcatttgtatgggaaacctctaaatgaccgagtttggagagctttccggccctgagtggtggtttccctcctctctgggccagtccggacgcctccctgagccattcaatcggtagtagcgacgggccaaccccggcgaacgatagttacctggttgattctgccagtagtcatatgcttgtctcaaagattaagccatgcatggctaagtataagcaattatacggcgaaactgcgaatggctcattatataagttatcgtttatttgatagtaccttactaccctttgacctcggagaatggcccatgtatccgcgttgacttctcgcccgagataatgtctctgaaatgggacggagttgacatggtctaaagctaggtttcgcaacgcttcgctgacatcaactatacatcgtgctcattagcgacagaagatcttgctcacatccggcatttctgtcaagtatggaaacaatgtgttggttgacagcacggggaagcctgaggttgcatttcgcatgtcgtttggtggattgcagcttggcatgaggtttccctcgtcgcaagtcgcttgtcaagccgatgctacgccgacgcagttaggagatgccttttcaacaccatttcgacaccattgctttttaatttctgtatcaagggttgcatgtaacggcttaccaggttggttgggccccatcacaccgaatgtggtactctctacacgtccaacagctatgtgtgcttcgagagggcgtgagcccgggttgaacggcctctagtgcagatcttggtggtagtagcaaatacttcaatgagagcttgaaggaccgaagtggggaaaggttccatgtgaacagcggttggacgtgggttagtcgatcctaagccatagggaaggcctccaccagagtttcctctggcttcaccctatacaggcatagttcaccttctttcgggtccggccccgtatgctcttgctcaaatttccctctgtggaaccctatgcccttcactgggtgtagcggggaaacaggacttttactttgaaaaaattagagtgctccaggcagggtgatacacgctatggctgacttccagttgcttatgtatactgttgtgggttgttttagtagggtaggtgccctgtaacgggccgggtgcttgcagcaggttatgtaaagtgtaggttatgttgagtataggttatgtaaagtgtaggttatgttgagtataggttatgtaaaggataggttaggtggcgtgtgttgtgtgtgaatatgctttggtggcattcccagtgaggcattatcatgcataaagatatcccctggaccaacaatatcaggcaatatagctgaatatagatcaacaatatgctggccattaacccggccgtcaagagctatcagcccggaacgcctctgatgactgaaggcagcccaaaacatctgacgaacagccccttttgatatgcttaagttcagcgggtattcctacctgatctgaggtcaaccttggaaagttgggggtttaacggcaggggctgtgcatggcgggaaagccaatacgtcgtctcgcaaagtgtcctttggcaatgcgccgtttccaaaaagagtgcaagaacaacgagcaagacttgggcaggttgatcatccgtggttctccgcggtgcactctgcctgcccaggccagcatcagttcgccccgggggctaaaggctttgggaatgtggctccctcgggagtgttatagcccactgtgtaataccctggggtggactgaggttcgcgcattggccaaacatggttgcaacgggtaacggagggttagggctcgaccccggagaaggagcctgagaaacggctactacactgggtcttttctttcccggtttgatcacggtgcatggaaccatgggtatctggaatgcgattcgggggtggagatgggtaaaatcggcccttagaggagttacggcagggccaccgacgccgcgcacggcaatccaccttccccctctcagttccccagggcatccttccaccacaccaagacccggcagggccaccgacgccgcgcacggcaatccaccttccccctctcagttccccagggcatccttccaccacaccaagcccactagggccggtgcggcttgggcgccccaagaggagtgctcagcgcacagcttcaaccatggcggtgtccgctgcacaattagtatgtggatagatgtatcttatttctggcgctgtctcattggtcaaaagcggaaaaagtgacatggctggcacggcatcgcacccaaagggatagatacagtaccattttttttttctttttttgctcctccttccagccaatcacgcgacaatcgcgcgacgagggtgagccaggtgagcttcagcctctttgaaacgagctaggcatctacgcaggaaggatgaggccattgctgactcatacatctagactgaaaggggaccaataggtacgcacctgggtgcgcacataagtgtcacgtgttgcgcacccggtgcgcgtgtaaggaagttatgccatccttgtgctatataccatcgatacattgcagcacgtacggcgtggtataacaagctgcctcgaggtagcttgaagttataattggtgtttggactataagcagatgggtaaacgatgcacagcaacagaacctagccgggagtggactaagttcacagaggctaggcatccaaccgtacggggctctcaccctctatggcgtcccgttccagggaactcggaaggcacgtcgcctaaggaggctgaaaagctgtatctccaagccctagaggccagaaagatatcccttggagagactcatccagatatattatttagcatatcaaacctcgctcagccacttgatgttggctgttttgggccactgaagaaggcctatggtaaagaaattgaagggataatgagagcgggggattacacacataacgaaggcggacttcctacccgcgtttttcaccgcatttaaagctgcaatgacggaacaaaatatccagggcgcttttagaggtgcaggccttattccatttgacccaaaaagcgtcttgtcacggctagaatacatatcgtaggcttatccgcctcctagcagcatatggccataagattggcggtcaattgcatcaatcatttcatgccaagtgaccaaatcggtaggaccggggaaggagaacgcctctgagaatgattcacctggtcgcatggatatcataccatccgatccagagccaaaccatacggcattgggttccatgtgaacagcggttggacgtgggttagtcgatcctaagccatagggaagttccgtttcaaaggcgcactttgggccgtgtggcgaaagggaagccggtcaatattccggcacctggatgtgggttttgcgcggcaacgcaactgaacgcggacttatctacattgttctatcaaccagaggctgttcaccttggagacctgctgcggttatgagtacgacctggcgtgagaacttatctacattgttctatcaaccagaggctgttcaccttggagacctgctgcggttatgagtacgacctggcgtgagacttattccttcccgcggattttcaagggacgtcgagagcgcaccagacccagcagaggtgctgggctcttccggccattagctctggttgccgcttgataaagttggaagcccaattgactccaacagggggcgcgccgcgtacgcgtagcaggatattggccatttccacagtatacataagcaactggaagtcagccatagcgtgtatcaccccgctaaaattccaaccccagcgcacccaacccactctgcactagaggccgttcaacccgggctcacgccctaggcttcgtcactgacctccacgtccgcctactcctcagggcagtctgctccaagcttcatcttactcgtctccatcacctgcaacccaagcttctctgcctcctcccaccggccttgattcgtatagacgtaatcaacgcaagctgctgacttgcgcttactagggattcctcgttgaagagcaataattgcaatgctctatccccagcacgacggagtttaacaactgttaaaccataacgcaggtgtcctaaggggggctcatggagaacagaaatctccagtagaacaaaagggtaaaagtcgccttgattttgattttcagtgtgaatttctagttatttttatttcttaagtattatattaaaataaaaagtttaacctttactatacttattaaactatattatcgtaggaaaaaatagtataataatatattttttttataaaaagtggggtaaaatcaagatataaggtttttcccctactctcccttcatctcttcctccaacaacttagagtatgtggttggatttgtggtggtgtgggtgcgctgtggttgattatgtagtgggttgggtgcgctggggttggaattttaggggggcacattgcgtcaacaccactttctggccatcgcaatgctatgttttaattagacagtcagattccccttgtccgtaccacttcgtagtactaataattagtaaactaaaactatatattaagttatatagttatctttcttattaagaataatagctatctactaaaatacttagtacttcttaatttaggaactatattatatttatttaatgcatcagtattcaattgtcagaggtgaaattcttggatttattgaagactaactactgcgaaagcatttgccaaggatgttggcatgggggcgaaagactaatcgaaccttctagtagctggtttccgccgaagtttccctcaggatagcagtattgaactcagcgggtcaactgtaacaagctggtccgatccgctgtgggaaatctcttcaactgtaccgtatcttgcagattcccactgattggtcagctttaaagataaggtatctaatatctatactcaactgatcagcttaagagcctctttcagataaaagtgggtcttataaaagctatatatatatcatgcaagcacccggccagttacagggcacctaccctactaaaacaacccacaacagtatacataagcaactggaagtcagccataatcatgcaagcacccggccagttacagggcacctaccctactaaaacaacccacaacagtatacataagcaactggaaggcagccatagcgtgtatcaccccgctaaaattccaaccccagcgcacccaacccactacataatcaaccacagcgcacccatcatgcaagcacccggccagttacagggcacctaccctactaaaacaacccacaacagtatacataagcaactggaagccagccatagcgtgtatcaccccgctaaaattccaaccccagcgcacccaacccactacataatcaaccacagcgcacccttttaagcatgtattagctctagaattaccacggttatccaagtagtaaggtactatcaaataaacgataacttatataatgataagcgacagcaaaagaagcttctagactacgtagacgtatgagaaccattctgaaacatcagcaatggtgagataaggtgtcctcaccgtgattaagcccccactctcgggaaagcatcaaaagatctatcgaagtataatattgtttcaggccgtctaagacgaggacgatcaagatagaaaagaccaggctgatggtaggtaggctagtcacaaagtaaagggattgacgtttttgcaaaagggggcaatggttaatttatagtaggaggagcttggtgatgcttctcggggttcttcctttattaagccatgcatgtctaagtataagcaattatacggcgaaactgcgaatggctcattatataagttatcgtttattttatagtaccttactacttggataaccgtggtaattctagagctaatacatgcttaaaatcccgacttcggaagggatgtaattaagccgcaggctccacccctggtggtgcccttccgtcaatttctttaagtttcagccttgcgaccatactcccccttgagcccaagcactttgatttctcgtaaggtgccgaacgagtcaatttttaacatcgtccgatccctagtcggcatagttgcagggcgctacagatcgctggatcgtattcttcaacgaactggccggatacgcgattttcaaggaggataacaaggcagaccaaatagccctgtacgctatttatggtcctctaattcaggatgaattagcccagtttgtgacgctgtggaatggccaccgtattcgaaatcagaagaatcgctgtccctggacacactggctgtccctggacatactggctgtccctggacacattagctgtccctggacacactggctgtccctggattcgtgagggtcgacgcccactatgaatcacccgccagcgaagccgaagccgtctagcctgtccaagtgaccactcagtcggggcggacgtggaggtcagtgacgaagcctagggcgtgagcccgggttgaacggcctctagtgcagatcttggtggtagtcgcaaatacttcaatgagaacttgaaggaccgaagtggggaaaggttccatgtgaacagcggttggacgtgggttagtcgtccaaggttgacctcagatcaggtaggaatacccgctgaacttaagcatatcaataagcggaggaaaagaaaccaacagtgattgccctagtaacggcgagtgaagcggcaacagctcaaatttgaaatctggcgcaagcccgagttgtaatttgtagatcagttgcgttgccgcgcaaaacccacatccaggtgccggaatattgaccggcttccctttcgccacacggcgcaaagtccgcctttgaaacggaacgatagagcattgcaattattgctcttcaacgaggaatccctagtaagcgcaagtcatcagcttgcgttgattacgtcccggccctttgtacaatattggggtttagaagtgtgaacttttccggtgaccagcctctgaagtcatatacgaactcgcccaacaggtcgctgctgtgcagctcggcgtattcatagcggtgtatacagcgtgccgcgtatacgtcagcgagtgcggcagtagtgatctgggctgcccaagaccacctatactgaccatttgcagtttttcaactttcaaggaaatcagtagtagacaagatagtcacgtagctgtggcattaatcaagctagggaatgtagcgagtagactattgtgttgttgtcgagaactaacgaataggttctatctagctaccgccactagatttaggggccggccgtccctcgcgggctttggccgatccccaacaccacgccctaggggcatgagggtggaaatgacgctcagacaggcatgcccgccagaatactggcgggcgcaatgtgcgttcaaagattcgatgattcactgaattttagatattaaaaagtaaatatatttttctaatatctaataaaattttaatttttattaattctaatttaaatatttagaagagcaagcgagccatctgtgaagatatacagcttcaagttgtgcagattgagcggtatgaagttgaggccgcggtcatggtgttccatttgccacgtgagtctcttgttgcctcgatttccccaatgcaggcggccctggtggctggctgcgtagggggtttgggagatggattacaaggacgccagagttctggcgcccggtctgaaagtgcaccgcatggaaatgaagacggccattagctgtaccatactcaggcacacaaaaatactgatagcagtcggcgggtgaatcattagccttgcgaccctcggcagcaagaaccatacgaccaatatcacgaaaatagtcacgcaaagcattgggccatgccctcgccgctctgtcctcccacgctttcggctttctgtcgagcgggagaagaaaaaaacattggccctttgtttccctctgcgacacaaggcttggccgactcagcttccgctctgcttctgtgcccgaagttaacccagccaaaaccgcctcccatgccctcgccgctctgtcctcccacgctttcggctttctgtcgagcgggagaagaaaaaaacattggccctttgttccctgcagggtagccagtctatctttacatcccgcacatctccttctccagtatcttaggcgatatagccttcagggtagcgtagaagagatgggatggcgggtttacaaaagtcatgtatatcggtcgcgcggtttggtggccgtgagtcgatttttttgcaagacgcccccctgtgccaatatcagaccctttccgtggaggatgttcaggcggttgcgaaggcccaggagatgctccatctccggatgctagatgagattgagacaggtccacagggtgaaggtttttattagaaataatatagatttaatattaacctaatatctatttatatatagttatttatactatataataagagaagaaatatattaaaaaggattttataaagaaagcttataaataaattattaaactagtatttaatagagtaatctagtaaatatagtaaattattaaactcttatttaaaataaagctaatatataaatatatagaactaaatatagaaatattaatctaaaaagctataaagagtatttagataataattattaaaattatctacgatggaagtttgaggcaataacaggtctgtgatgcccttagatgttctgggccgcacgcgcgctacactgacggagcccgccgaagtcgggattttaagcatgtattagctctagaattaccacggttatccaagtagtaaggtactatcaaataaacgagaacttatataatgagccattcgcagtttcgccgtataattgcttatacttagacatgcatggcttaatctttgagacaaagactctaggctccgtacgcccttttgcctcccttagcatgggcacacgaccgtctgcttaccttttgatctcaggatgcgcttataattcagactacaagcgtggaagtagacgaaggaccgtacgtcaaatctccgcagagatatcattcaattgaatactgatgcccccgactgtccctattaatcattacggcggtcctagaaaccaacaaaatagaaccacacgtcatattttattattccatgctaatgtattcgagcaaaggcctgcctggagcactctaattttttcaaagtaaaagtcctgtgagctgtttccatttaaccccaattccacttcaataggccgttattatcagcctttttcagctgtacgaggcttttgaagatatgtgctgtggttggatttgtggtggtgcatgcacgctgtggtggaatttacagtggcgtgcattcgctgtggttggatgtgtggtggtgtgggtgcgctgtggttgattatgtagtgggttgggtgcgctggggttggaattttagcggggtgatacagcagatgggggggttgtgttcttggattacccgtatcgtgaatccaaacgccttccttcggcgcaagaaatagtgtgtgtgctttatgcggttgaacagggaggatgatggacgatgcgaggcttaggaggaggaggctataactattgggggaaacaggtaccagagtcttaaaagcttccagaacctttctatcgtcggtctctccatctacctatcctaattggggtatatatctaatagtgtttaaatatctactaggattattggttctacactaggacttgatcaaaaagcgacgtcgctatgaacgcttggccgccacaagccagttatccctgtggtaacttttctggcacctctagctatcaaaaagcgacgtcgctatgaacgcttggccgccacaagccagttatccctgtggtaacttttctggcacctctagcgtcacacgtcgaaggtaatcgcctgctaagacgctaagccgaagcctattcttgtccatctgtacgtgcgggtggtatcaccgctttctggcattgattctgacttagaggcgttcagccattatccagcagatggtagcttcgcggcactgcccggtcggacagccgcaaaaatgactcaacacggggaaactcaccaggtccagacacaatgaggattgacagattgagagctctttcttgattttgtggggggtggtgcatggccgttcttagttggtggagtgatttgtctgcttaattgcgataacgaacgagaccttaacctgctaaccagtgctttcctagacgcgttggagggtctgacggagggagcaaagttgaggctatcgcaataacctggctatgtgatagagcattgccgagagcatcttgaatttgcacccatccagctaattcggtctcctgcttcccaggctcatgggagggcgtcccgcgggcgctgcagggtatgtaaaatcaaaaaagttgttaagagccgcggtaaattaagaagttatcatgaatcaccagagagccccgaagggcattggtttttaatctaataaatacatcccttccgaagtcgggcttttaagcatgtattagctctagaattaccacggttatccaagtagtaaggtactatcaaataaacgataacttatataaactcgcctggcgacttgaccctcacctatctgaccagatatcatggagccggcaatcaatgagccgtctgcttgatgacacgtataggtgcaagaaggatgaggtcaacaagtttcgtcataaatcacgctagcatctccgagaatgcggattattttgaggatcccctgagcttcaagcccgaggagatggctcgatgggaacgagacagacttggctgccggtagttggcagtttggaggtggtcgacggccctgtgtggggtttcacaatacaacgaaaataacgcacctcctccagcgttatggctactcaactccttgtttctcaccgtatcacgattaaggtcatgtgaggtgcaggttatgtaaagtgtaggttatgttgagtataggttatgtaaagtgtaggttatgttgagtagaggttatgtaaagtataggttaggtggcgtgtgttgtgtgtgaatatgctttggtggcattcccagtgaggtgcatgtgccgctgcgagcctccaccagagtttcctctggcttcaccctatacaggcatagttcaccttctttcgggtccggccccggatgctcttactcaaatccatccgagaacatcaggatcggtcggagatgcgccgaagctctctcctacgttcactttcatcgtggcgtgcaagagggtaaatgtgggccggtgtatttctgaagagtacccaggctcatgggagggcgtcccgcgggcgccttatgagacaagatggtgtctgctgagaactaataatacattggtgcgtccaatgaggtggttgatcgtattaatttagacgtatgcccacatgctacgtcagctgacctgcaagtgtgccatcaccagggtcttgttggaactaaaagcacggatcaatagatattagattaatattaaatctatattattcctaataaaaaccttctatagtagtaaatatatactatacttataaagataaataaccatggcggtgtccgctgcacgtggcgatctcccgttgctcagtggtaagtttagccagcggccatccatccacagaaaaccatggcggtgtccgctgcacgtggcgatctcccgttgctcagtggtaagtttagccagcggccatccatccacagaccccatccagcgccggcgagagcagagctctccccagaccaggcatcctcagtacgacgtaccgcacgcggccgctttcgtatattcagctatattgcctgatattgttagtccaggggatatctttatgcatgataatgccccttctcatacagcctacatcgtaagagctctgctaagggagctacgaatgtaggtccagttggccagctatgggagtcacgcggtgcgccgtccttttttggcagctcttacttcggcccgcaagctgtagcggcgctgttggacacgtcggcgccatatctccagcctggcgcaaacacgtctctccgaagctcgactgcacgcagttgacccgagacgctgtgagtggtttgctgcagcgccttaggctttcgccttcagcactcgcgcccctctctcataggtcaagctgaaagcaggagtctaacatcaggatgcttgcttttggtcggccgccctatgctaacccgcaaggccacaactgtcaggttttgtttcggatgtgaaattaaattataaaattgtggcctgatttctccttatcggtagaaactaatcggtccgactttcctccttgaatatccaagagccctgaagataacacgttgccttctgtaatacgggctcgtaaccgctgtaaggttctcgtacagcggatacgaggtcttcaaaaaaagtcatgtatatcggtcgcgcggtttggtggccgtgagtcgatttttttgatttcccatacaaatgaatttgaacgctctcgcatctttgccaccggacctggcagccacataccggcgtatgattgaaagcataacgacagaactcaagaccgacgcgatgcggctcctgcgatttctagtgcatatggagcgaccactcacgctggcggaggctaaggaacttatagctaagggccggtgcggcttgggcgccccaagaggagtgctcagcgcacagcttcaaccatggcggtgtccgctgcacgtggccatctcgtagttgaaccttgggcctggctggccggtccgcctcaccgcgtgtactggtccggccgggcctttccctctgtggcaccctatgcccttcactgggtgtagcggggaaacaggacttttactttgaaaaaattagagtgctccaggcaggcctttacgccagagttctggcgcccggtctgtctctcgggaagcggctgcagggtagccagtctatctttacatcccgcacatcgccttctccagtatcttaggcgatatagccttcagggtagcttagaagagatgggatggcgggtttacaaaagtcatgtaaggggttaagtaaaggtaaaaagcgggcccaacaggtaacccaggggttaacccgttatggcgagtacaagggttagggttagggttagggttagggttagggttagggttagggttagggttagggttagggttagggttagggttaatcattacggcggtcctagaaaccaacaaaatagaaccacacgtcctattttattattccatgctaatgtattcgagcacaggcctgcctggagcactctaattttttcaaagtaaaagtcctgtttccccgctacacccagtgaagggcatagggttcaatcagcggggaaagaagaccctgttgagcttgactctagtttgacattgtgaaaagacataggaggtgtagaataggttggagcttcggcgccggtgaaataccactactcctattgtttttttacttattcaatgaagcggggctggatttacgtccaagtactcgttgtatggcatcacgtgggctgaatttttgccttgctttcattggtttagatttggccggaccgagtcttgtgagtgcctcgagattgtgcttccatatctggtgttttatcggcaggaggtgtgtctcgacgtctagtgccgggcgaaagagaagaaagagaagaaagagaagaaagagaagaaagagaagaaagagaagaaagagaagaaagagaagaaagagaagaaagagcattaatcaagctagggaatgtagcgagtagactattgtgttgttgtcgagaactaacgaataggttctatctagctatgaagccgaattggatcattggttgatgatagagtgtggaacgcacgcgatgccgttttggtgtcaagaagtttcctgggctatatttaattagaaacccaaggatgactccgtttctcaggctccttctccggggtcgagccctaaccctccgttacccgttgcaaccatgtttggccaatacccaaacatggaagataacccccatcataaagccggtctcgtcaaagttgtataggtcctcatctaggatgccgtattttgccttcagattgcgtacgagagtaaaccaaggtccaataacctttggatcttcgcatttggccctctgatagtcatatttccgaacccagcgcgtaaagaaggaagccccacgccaatgcccgccaaggtcccttaataacccggtgatccaatccctcttgctgccgtagctgatcacccctatctactgcgcccatatgatcgttataatcagcagctgccgtcaagacccgtgcctctttgacagctacataatcaaccacagcgcacccacaccaccacaaatccaaccacagcgaatgcacgccactgtaaattccaccacagctcacacacaacacacgccacctaacctatactttacataacctatactcaacataacctacactttacataacctatacgcaacataacctacacacgcccactatgaatcacccgccagcgaagccgaagccgtctagcctgtccaagtgaccactcagtgggaatctgcaagctacggtacagttgaagagatttcccacagcggatcggaccagcttgttacagttgacccgagacgctgtgagtggtttgaccttcaagtcacttcagcaaaagtggggggtaggtggagcccgtgacatggctggcaccgcatcgcacccaaagggatctatgctgtgcacgccggaccatccaccattctaacccacggtgataagtggatacccatcttacactgcagtggcccctctgcgtgacatggtgattggcgggaaaagtgggtatcacacgtgacttgtatacgtgttggggtgaaattcgtaacacactagctgctagcgatcgtaaccactagcctctagcgattacggccactggccacaatcgctaataaccccctgctaacgctagcgtatttgctactaccaccaagatctgcactagaggccgttcaacccgggctcacgccctaggcttcgtcactgacctccacgtatccctgtggtaacttttctggcacctctagcttcacacgtcgaaggactaaaggatcgataggccacactttcatggctttgaaatactggccttctcacttccctccgatccgcgtggaaggcgggagaccggtttgaagttggggtaccgggtaggccgaaaccacatgaaatactggccttctcacttccctccgatccgcgtggaaggcgggagaccggtttgaagttggggtaccgggtaggcggtaaaatcattgaatggaaggatatatgaatggtcgtccatggttgctgcagacacgagtaatgggaagttaccgaatcactgctgagctagaagagatcaacctcgaagccttcccgccaacgcagcctctccctgacgttagcgacgatgaagaggaggaaatacaggttattgaagagcggctgcgagagccctctgttgaagccggggatactgttgagtctgcgcgtattgtaattttaaaacgagcggggtcaaatcctttgcagccgacttagctgtgcgaaacggtcctgtaagcagtagagtagccttgttgttacgatctgctgagggtaagccgtccttctttctggatgtactaacaccttttgtggtgtctgatgagcgtctactctggcaccttaacctcgcgttcggttcatcccgcgcacattgcgcccgccagtattctggcgggcatgcctgtctgagcgtcatttcaaccctcatgcccctagggcgtggtgttgggtcggtcgcgcggtttggtggccgtgagtcgatttttttgatttcccatacaaatgaattttgcggaaaatcaaaagtggaccgggaaccgaccgtggcgtgaagcccgcgagggacggccggcccctaaatctagtggcggacccgtcgtggcctcctctgcgaagtagtgatattccgcctcggagagcgacgagcccctgccgttaaacccccaactttccaaggttgacctcagatcaggtaggaatacccgctgaacttcttgttgaagaagctgtcaaagtacgtaaaggctacgaatatctcgactccatcagcctgaacgtcttggctaccaacttcttcctcttcgcatgccactatggacttgaatcgcacgatcttttcaacgtggatttcagtgaatataatatcggcggctttggcgctcttggtcccggctgtcctctacgtcgccatcctgtggcttctttagccgcgcaatcagccagttcattgccatctatccccttgtgggctgggatccatcggatctccacggttgatttttgaatctatcgcgattttcatctgggtgttccgttgaggggggtgttccgttgaccagggttacaacttatacatagttgcggaagcggcactaactgagcccgcaagagcacgcggggtctggttatgctccagctggcagctgagatccatccgagaacatcaggatcggtcggagatgcgccgaagctctctcctacgttcactttcattacgcgtaggggtttataaatgctaggctatctcctcagatcatgtatatctcttgctcgggaccctaatttatataggaaatcatcgtgaaaagcgtatccgagaccattgggatacctacaagccggggtgcgaggtttgatatgctaaataatgtatctggatgagtctctccaagggatatctttctggcctctagggcttggagatacagcttttcagcctccttatatcgattcccagtgaggtgcatgtgctgaagtttggttcccggcgatgtgcatgtgctgtggttggatttgtggtggtgcatgcacgaacgatgtacaaaatccacggcgaccacggcatctgactacaaactctgatacctatgcagctaacgataagacttggtagagagatttgattagtttgacaaagagtaagggtgaacatcacaccgagtatggtcggaagggatgctggtgtaaccgaaccggccctccctgtatctagccactgtcctcgacttacagcgcttcccaccctctaaaacaataatttaccgcggctctaccactgagcaacgggagatcgccacgggcagcggacaccgccatggttgaagctgtgcgctgagcactcctcttggggcgcccaagccgcaccggccctagtggtcatcacatagccaggttattgcgatagcctcaactttgctccctccgtcagaccctccaacgcgtctaggaaagcactggatggagggctttttgaaacggaacccggaaattaagacacctatactcaacatcacctacactttacataacctgcacctcacatgacctacactttacataacctgcacctcacataacctgcaccccacagttgttcctcgttaagggatttaaattgtactcattccaattacaagatccaaaagaaccctgtatcagtatttattgtcactattgttcctcgttaagggatttaaattgtactcattccaattacaagatccaaaagaaccctgtatcagtatttattgttactatatttccgaacccagcgcgtacgaagctctggttaccgcttgataaagttggaagcccaattgactccaacagggggcgcgccgcgtacgcgtagcaggatattggccatttccgaggtagctcttaaaaattaattatttaagctttatattatttttagttatatttagatcagggtattagttttattaggttaacttcctacttaactttcttatagtttctatatctctagttattatattatttaatctagctattatatatatatattatttaatcttctataacccctgcgttctcatggtctgcagatggaacggctcaaggatatgcttgatttctgccaagagcctccagtcatcccccctcaacatgtcggcctcgggtagccacttctccacctctggatggaccaatcgctccccagccatgatccaattcttcccctggaccttgcacttccatggccctgcctttatcaagtacgcggtcgacgttgcacacgccgcttcggtccctgtgtctgtccacctcgaccactgcttgaagccgagcgatgcggatctggcactagagtgtgcattcgactccatcatggtggatgggtcatatttgacgatcgatttgcacgtcagaaccgctgcgagcctccaccagagtttcctctggcttcaccctatacaggcctagttcaccttctttcgggtccggccccgtatgctcttactcaaatccatccgagaacatcaggatcggtcggagatgccgatgattcactgaattctgcaattcacattacttatcgcatttcgctgcgttcttcatcgatgccagaaccaagagatgcgttgttgaaagtttttatttatttgtaaaaactactcagaagattccaaaataaaacaagaattaagtttcctaggcgcgatgattcactgaattctgcaattcacattacttatcgcatttcgctgcgttcttcatcgatgccagaaccaagagatacgttgttgaaagtttttatttatttgtaaaaactactcagaagattccaaaataaaacaagaattaagtttcctaggcggaagcaggagtccgaattagctaaatgggtgaaaattcaagatactatcggcaacgctccgtcgcatagccaggttattgcgatagcctcaacgctgctccctccgtcagaccctccaacgcatcttggaaagatagctcttatttaattaattaagtttttatttatcttattttattaattttaattagagtttagatttaaagttaattaaacttagtattaaataaggttttattattaaatagaaaaagtaattatctagaagttaatattaatttatctctataaatatgctagcgatcttagccactggctattagtgatcaaattagctgttaaagaccgctattagcggtcccagccactagccattagcgatcgcagccactagctgctagcgatcgtaaccactagcttctagcgattgcggccactggccacaaccgctaatggcaccagacttgccctccaattgttcctcgttaagggatttaaattgtactcattccaattacaagatccaaaagaaatcaagaaagagctctcaatctgtcaatcctcattgtgtctggacctggtgagtttccccgtgttgagtcaaattaagccgcccttaatttcccttgggttgaggctccccgctgaccattgtcaggagatatccaaagggataggttgtcacggaggatgcacatggtagatatgctctcaacatcaggctgaccaccacttcaacaaaagtcatgtatatcggtcgcgcggtttggtggccgtgagtcgatttttttgatttcccatacaaatgaattttgcccattgctagcagaacaaagcgatagtaacctttgagaaactggtagaattcgaccaagaatcgtcttcagttcttactctgctctgtattaatgtcgccggcatctactccgtcaagaacctaccatgaaagacactaccgtaatattgcagacaagtgtgggtgcgctgtggttgattatgtagtgggtggggtgcgctggggttggaattttagcggggtgatacacgctatggctgacttccagttgcttatgtatactgttgtggggagaggatgcattggatcgagcaatgtcttttgcgtgatttggtacagcatgcggtctttattgggcgtggtttgtcactttttcagtggctagatacagggagggccggtctactgagcgtgagctacaggcggtgagatagcctgtggggtgcaggttatgggaggtgcaggttatgtaaagtgtaggtcatgtgaggtgcaggttatgtaaagtgtaggttatgttgagtataggttatgctcaacataacctacactttacataacctatactcaacataacctacactttacataacctgcacctcacatgacctacactctcaacataacctacactttacataacctatactcaacataacctacactttacataacctgcacctcacatgacctacgctttacctcataaaactgagttcaatactgctatcctgagggaaacttcggcggaaaccagctactagaaggttcgattaggctttcgcccccatgcccatatttgacgatcgatttgcacgtcagaaccgctgcgagcctccaccagagtttcctctggctctactgcttacaggaccgtttcgcacagctaagtcgtctgcaaaggatttgaccccgctcgttttaaaattacaatactcgaaatactacagcacacttctagtaccgtagagtaatcgcctgctaagacgctaagccgaagcctattcttgtccatcactaataagtatatatttaactagatatatatacttagatattatttattaattaattaaataatctttctaaatctaatgtagtgccacgaacaagccttcctttaaaaggaagaatccgaccaggccgtagttaaaagaatcaagctattacaatcctggacgagtgcgggcgcgtgacaccaagcaataactctaaattcaacatggatcgcaggatgctgcagcacatgggcaaaagtagcatcgagacgtgtatcacctcggccatggtggtcatctccatgattcatacggtaatcatgtccagtggttggatcgccccgaggtctgccatgctgctgatcgtctccggatgcttctccccaagaacctcccgtcggagatctagtaccctgattaacggtaagcgttggattgttcacccactaatagggaacgtgagctgggtttagaccgtcgtgagacaggttagttttacccttcggtaagcgttggattgttcacccactaatagggaacgtgagctgggtttagaccgtcgtgagacaggttagttttacgcttgcacgccacggtcagttcccgggccagttttgattttccgcaaaattcatttgtatgggaaatcaaaaaaatcgactcacccccggagaaggagcctgagaaacggctactacatccaaggaaggcagcaggcgcgcaaattacccaatcccgactcggggagggttcctgattaatgaaaacatccttggcaaatgctttcgcagtagttagtcttcaataaatccaagaatttcacctctgccaattgaatactgataataatagtaataatagtaataatagtaataatagtaataatagtaataatagtaataatagtaataatagtaataatagtaataataacaatgaggattgacagattgagagctctttcttgattttgtgggtggtggtgcatggccgttcttagttggtggagtgctttgtctgcttaattgcgataacgaacgagaccttaacctgctaactagcccgtattgctttggcagtacgctggcttcacaatgaggattgacagattgagagctctttcttgattttgtgggtggtggtgcatggccgttcttagttggtggagtggtttgtctgcttaattgcgataacgaacgagaccttaacctgctaactagcccgtattgctttggcagtacgctggcttcgtactatcaaataaacgataacttatataatgagccattcgcagtttcgccgtataattgcttatacttagacatgcattgcttaatctttgagacaagcatatgactactggcagaatcaaccaggtaactatcgttcgccggggttggccaccagcgccaccacttcaaaaaaagtcatgtatatcggtcgcgcggtttggtggccgtgagtcgatttttttgatttcccatacaaatatgttggctgctttggaccactaaagcagtcgtacggaagagaggttgagaagctaatgcggatgcatattacccacattagcaagcttgagtttctctcttcctttcgtactcgccaggtgactgaaaacattcgtgaatgaacaatcgaatggcaggaaacccgacacttcgctaccgaattcgtccgacctactcaagaaagcatagatctacgcccgaacttataggcggacgtataaaagcttagggagacaattaaaacttattacccctggtggtgcccttccgtcaatttctttaagtttcagccttgcgaccatactccccctggagcccaagcactttgatgattttccgcaaaattcatttgtatgggaaatcaaaaaaatcgactcacggccaccaaaccgcgcgaccgatatacatgactgcgagtgttcgggtgtcaaacccctacgcgtaatgaaagtgaacgtaggagagagcttcggcgcatctccgaccgatcgtgatgttctcggatggatttgagtaagagcatacggggccggacccgaaagaaggtgaactatgcctgtatagggtgaatgcgagtgttcgggtgtcaaacccctacgcgtaatgaaagtgaacgtaggagagagcttcggcgcatctccgaccgatcatgatgttctcggatggatttgagtaagagcatacggggccggacccgaaagaaggtgaactatgcctgtatagggtgaaagagctctgctctcgccggcgctggatgggttctgtggatggatggccgctggctaaacttaccactgagcaacgggagctcgccacgtgcagcggacaccgccatggttgaagctgtgcgctgagcactcctcttggggcgcccaagccgcaccggccagagctctgctctcgccggcgctggatgggttctgtggatggatggccgctggctaaacttaccactgagcaacgggaggtcgccacgtgcagcggacaccgccatggttgaagctgtgcgctgagcactcctcttggggcgcccaagccgcaccggccctttgaacgcacattgcgcccgccagtattctggcgggcatgcctgtctgagcgtcatttcaaccctcatgcccctagggcgaaagaaccctctttgggtcgtacggtattaggccagatccaataaagcctgcctggatattttcctctgtaaaggagtagaagaaagctgtacgaaaggaagagacacttcaaaaaaagtcatgtatatcggtcgcgcggtttggtggccgtgagtcgatttttttgatttcccatacaaatgagttttgcggaaaatcaaaagtggcccgggaaccgaccgtggcgtgcacgagggtaaatgtgggtcggtgcacctatgagacacttcaaaaaaagtcatgtatatcggtcgcgcggtttggtggccgtgagtcgatttttttgatttcccatacaaatgacttttgcggccacctaacctatactttacataacctatactcaacataacctacactttacataacctatactcaacataacctacaccttacataacctgctttctttaagtttcagccttgcgaccatactccccctggagcccaagcactttgatttctcgtaaggtgccgaacgagtcaagccaactgacggcatttattaccctgcccgttaggttgagagcgtgtcttgagaatcccataccatgacaagcgagatgaagggaatgtattccgttgggcaggcctaacctcataaggtatggctggaataagggggtttaaaattcgtcattagtgtacccgctgaacttaagcatatcaataagcggaggaaaagaaaccaacagggattgccctagtaacggcgagtgaagcggctatatatttattttattagatagaatactcttttagacagttattaatataattatctatatatctattattactagctttataatacttatatattaataggcgtccttgtaatccatctcccaaaccccctacgcagccagccaccagggccgcctgtattggggaaatcgaggcgaagggcattggatcgagcaatgtcttttgcgtgatttggtacagcatgcggtctttattgggcgtggtttgtcactttttggaatttaatccatactttcaccgctttattattctaagctagataaagagggatctcaactaggccttatcgaataaaaggatattgtgttggggataaacgaacaacaccgcagctgttagcgagcttgaaatgcagactgtcgaccacaccaaaatctcactactttcgtttgtgtggcaatgatatttgccagctcagcaatccttgttgcacccgccattgtcaataatcggtatgttgcatttgtgtaatagattaaaatattcagttgattgatatttcagtcgcgcacacccttcaattgaggaaactccggtaacctcgcgttcggttcatcccgcatcgccagttctgcttaccaaaaatggcccactagtattgatacattcgaatgctcagtcgagtcggcctgtggccattgcaaatcgtatagttgcatggactgcctgcatgtttggcgtccactttgcgtcatctttatggtgattttcctcctaggcagaacgagaggtttcctctcaatgtctccgtgcactgcaacatttcagtcctatgcgctgtccatttcgtgcatcgaaaaatcctttgcagacgacttagctgtgcgaaacggtcctgtaagcagtagagtagccttgttgttacgatctgctgagggataggttatgtaaagtataggttaggtggcgtgtgttgtgtgtgaatatgctttggtggcattcccagtgaggtgcatgtgcctgctggcgctatgggcgtatgaaatgtgggcattgggaccgaaggatatgcgcccttcaagggaggagtacgtcaaagaggatatccttgagtacttcggtgatgtattacaaggaaaaggaaacaaggatctctacgtagagatactggcacgaatgatccgggccggtgcggcttgggcgccccaagaggagtgctcagcgcacagcttcaaccatggcggtgtccgctgcacgtggcggtctcccgttgctcagtggtaagtttagccagcggccatccatccacagaacccatccagcgccggcgagagcagagctccttcaactgtaccgtatcttgcagattcccactgagtggtcacttggacaggctagacggcttcggcttcgctggcgggggattcatagtgggcgtcgaccctcacgaaagcggccgcgtgcggtacgtcgtactgaggatgcctggtctggggagagccgggtatagggtcgctggttgtggtttctgcctacccggtaccccaacttcaaaccggtctcccgccttccacgcggatcggagggaagtgacggatcggaccagcttgttacagttgacccgagacgctgtgagtggtttgctgcagcgccttaggctttcgccttcagcactccggatcggaccagcttgttacagttgacccgagacgctgtgagtggtttgctgcagcgccttaggctttcgccttcagccctcgcgcccctctctcataggtgcaccgacccacatttaccctcgtgcacgccacggtcggttcccgggccacttttgaggtgcaccgacccacatttaccctcgtgcacgccacggtcggttcccgggccacttttgattttccgcaaaattcatttgttaggtgcaccgacccacatttaccctcgtgcacgccacggtcggttcccgggccacttttgattttccgcaaaattcatctgtggagtgctcagcgcacagcttcaaccatggcggtgtccgctgcacgtggcgatctcccgttgctcagtggtaagtttagccggcaatcctacgtgaggaggttgctactcttcggaaggcaaatgaggcactaagcaagcgccggagagctaaaaaaacacgtctacgacaggcaatcctacgtgaggaggttgctactcttcggaaggcaaatgaggcactaagcaagcgccggagagctaaaaaaacatgtctacgacaaggaggatccttaaatgtataggaatcacaggatatagtagcccaacaggaggttaatagtcagattacccaggaagagcacttgggtcggggtcggaatgagcgtctactctggcaccttaacctcgcgttcggttcatcccgcatcgccagttctgcttaccaaaaatggcccactcgtattgatacattcgaggctgtagctatagcccctaagaggggaagcttattatctaatagtaataactacctttcctttctaacttaaagcttacagctggcgcaaagtgcgcctttgaaacggaacttccctatggcttaggatcgactaacccacgtccaaccgctgttcacatggcacctttccccacttcggtccttcaagttctcattgaagtatttgctactaccaccaagatctgcactagaggccgttcatgcacacgtcgaaggactaaaggatcgataggccacactttcatggtttgtattcacactgaaaatcaaaatcaaggggaccagcctggcgcaaacacgtctctccgaagctcgactgcacgcccattccgggatgaagctggtccgttctctcaactttgggacttgctaggcatgcttccgcgccaacgggccaccgttgaccgtctggtggatcgttttctacacgatgtggctgcgaggtattcctcatgggctgcttcagccatttcacggcgagtgaggccagaatcagagccatcaagacgagcagcaacaagatgagtgaaggagaaaagagagatgatagtcttaataaaacgcattttgaaaatcggaaagaaattagaggcgttcagccattatccagcagatggtagcttcgcggcactgcccggtcggacagccgcaaaaaccaattatcttaatgagcggttcagagcgcaccagacccagcagaggtgctgggctcttccggccattaaaccctagctccggacaaaccgatttcagggtgctagaccgttaagaagaaaagagaactctgcctggggcccccgccgtcgtctccgcgttcagttgcgttgccgcgcaaaacacgtgcagcggacaccgccatggttgaagctgtgcgctgagcactcctcttggggcgcccaagccgcaccggccctaggggtcttggtgtggtggaaggatgccctggggaactgagagggggaaggtggattgccgtgcgcggcgtcggtggccctgtgaaaatggatggcgctcaagcgtctcacccatacctcgccctcagggtagaaacgatgccctgaggagtaggcggacggggaggtcagtgacgaagcctagggcgtgagcccgggttgaacggcctctagtgcagatcttggtggtagtagcaaatacttgacagattgagagctctttcttgattttgtgggtggtggtgcatggccgttcttagttggtggagtgatttgtctgcgtaatataaacctactaattaattagtatactagctatatagagtagtagtacccttctaaatatctaaatcaggattaatagaaattaaaattttattagatactagaaaaatatatttattttttaatatttaaagatactattataaaaaataataataacttataataataagtagatatagtgctggggttggaattttagcggggtgatacacgctatggctgacttccagttgcttatgtatactgttgtgggttgtttgagtaagaactgaagacgattcttggtcgaattctaccagtttctcaaaggttactatcgctttgttctgctagcaatggcttgacatagactaagaaacaaagataagactagagaagagagaaagggaaccctgctaactaagagtacataattagcaagggatagcttcaaatgcaacgtcgacggcaaggatatatatgaatctcctcctttctgtctgtacactgattgctccatgcctcatgatgaccttgacagttagcacacttccgaggtacgctcctgtcagacttcatgggacactcgcgggacccatggtcttgagcgcagtagccgcattttcttattgccttgcaccacgttcaattaagcaacaagagcttcttacatatttaaagtttgagaatggatgaaggcaatatatagcccccgggtcgctaatcattcgctttacctatatagtttatattatatagatttaatttatatatatatattatattctaaaactatagtctatacttttttttatagatctagataattataatattatttaattctattaaatattttcttaactccttagtattctaagagtaaaggctgttcaccttggagacctgctgcggttatgagtacgacctggcgtgagaattattccttcccgcggattttcaagggaccgatatatatagcttttataagacccacttttatctgaaagaggctcttaagctgatcagttaagtatagatattagatattaaagattagatatagattagaacttaattaaaaactaattatatagattatattatatatagcctgatcttaggatattacctataaacccggtgttgcaatccctctgaagcccgaagttgatcaccgatatcaacaccacccatattgtcattgtaatcagctgaaactgacgggatctgaaggaatttgaccggctttccgctaaattccctcttgatcgggcgtgcccttgctttcgcctcagcagatcgtaacaacaaggctactctactgcttacaggaccgtttcgcacagctaagtcgtctgcaaaggatttcaccccgctcgttttaaaattacaatacgcgaaatactacagcacacttctagtaccgtagagtaatcgcctgctaagacaaacccttgatgagcccgtatgtgatgaagccggtgtttgggcccttccggccaccttcaactcctccctcaactcctccaaagctaatacatgcttaaaatcccgacttcggaagggatgtatttattagattaaaaaccaatgcccttcggggctctcttgtcacccagacactctcaccatgatcatgcaagcacccggccagttacagggcacctaccctactaaaacaacccacaacagtatggatcgagcaatgtcttttgcgtgatttggtacagcatgcggtctttattgggcgtggtttgtcactttttggaattttcctcacggccaccaaaccgcgcgaccgatatacatgacttttgtaaacccgccatcccatctcttctaagctaccctgaacgctatatcgcctaagatactggagaaggagatgtgcgggatgtaaagatagactggctaccctgcagccgcttcccgagtctccacaggaacagtacaaggctctccactctcaccgattctctacactttctataatgcagatcttattgaaagctgtagcctggtagaagatactatagccactgggtttatcgacgacgtggctatcctcacatggggagatacgacgacggaaacatgtagcaagcttcagcagaaaatatcttatactaaaatatcttatactaaaatatcttatactaaaatatcttatactaaaatatcttatactaaaatatctgaagagcaataattgcaatgctctatccccagcacgacggagtttaacaagattacccaggcctttcggccaagggaggactcgctggctccgtcagtgtagcgcgcgtgcggcccagaacatctaagggcatcacagacctgttattgcctcaaactgaagtgggtggaataagaggcaggcaaccttgatcctttatatcttcgcagatgggatccaacggttgaaaccgaaggttattttccacggcaagcccgagggtcagatctttgaaaacgaagggtatctttactcacctgacgttactgttgaattcatttcgaagtctaggcatcaagacgatgggtgtgtggactaacccgcaaagagaagatttcgatctgtatcggatgattgtatcaccaccacggtatgggcttggtcttctacttccccatccagaagggagttagcaacgagcaagtattctccagcctccaaaagggcctcaatcgcacctttgacatgatccccgcacttggcggcaaaataatgaacgcctctgagcaggagattgggctacatagctctggaagctgtcgatttaaactcagcccgtaccaaaactatactgccgattgggacacatctgctgttgatcggagcttaacttttcaccgaattccctgtcaagttctaatgatgaggtccacttagcacgctaatacctcttgagtcgcgcatctcaacctttgcgaagcaatccgacttgtataatcagcagctgcagacaagactggggcctcttttaccggctcagcaccaaagaattgcttgatagcccgtgcccgtgcgtgtgttgttgtcggccgcttccggatacgtgttgtaaactctgtgccctcgtagactgtggatagcagcagcacaagataaagaattttcaaggtaattagaactatgcagatgatggcggaaccgagagagcaccagtgtcccaggcggtacggcgcagcgcggtacacctgtgtcgctatgaacgcttggccgccacaagccagttatccctgtggtaacttttctggcacctctagcttcacacgtcgaaggacggggctctcaccctctatggcgtcccgttccagggaactcggaaggcacgtcgccagaaacatcctctacaaattacagagttcgccgggtatagggtagctggttgtggtttctgcctacccggtaccccaacttcaaaccggtctcccgccttccagagttcgccgggtatagggtagctggttgtggtttctgcctacccggtaccccaacttcaaaccggtctcccgccttccccgcggatcggagggaagtgagaaggccagtatttcaaagagctcgcgaagctgattattctgaccaccacttcaaaaaagcatagtttatggttaagactacgacggtatctgatcgtcttcgatcccctaactttcgttcctgattaatgaaaacatacttggcaaatgctttcgcagtagttagtcttcaataaatccaagaatttcacctctgacaattgaatactgatgcccccgccccggctcaatcattgttatctccagcgagaacgtctttcggcctggcgataatcagacgtggtatagcgcgagtaaagcggctgtctctttagcaactaaatctttagcgcttgagtttgctaaggatcaactccgctttaacactgtctgccctagcgccggtgaaataccactactcctattgtttttttacttattcaatgaagcggggctggatttacgtccaacttctggtgcgccggtgaaataccactactcctattgtttttttacttattcaatgaagcggggctggatttacgtccaacttctgggtttaaggtccttcgcgggccgacccgggttgaagacattgtcaggtggggagtttggctggggcggcacatctgttaaacatcacatacgggctcatcaagggtttagctacattaacaggccacaagccggaccccttccagcccgagcgaatattcatatctgttagaccgatcaatcaagcctttgtataacactgaaggaaggtcatcttgctgattggtgatgaatcaattagaatatccttcttcgcaagctccgacggtctaaacccagctcacgttccctattagtgggtgaacaatccaacgcttaccgaattctgcttcggtatgatagtaagagccgacatcgaaggatcaaaaagcgacgtcgctatgaacgcttggccgccacaagccagttatccctgtggtaactgcccatgccgtcaacccggcctccgacaattttctgttcatctcagatcagcatagcttcggggccatgagactaggacttctgcatcagctataccggttcctcttcgagacgtgaagcaggcctcggccgttcgtgatggacgacttcatcacccgttggtgatgtcgaattgacaccagatgaccatgccgaccaggcaggctggttgaacaaccttgggaacaagcttgagagccggtacaagcggacaggcgagatggcagacctagaagaggctatcaagagttggtagccgaggttcaatcaagcctcaatgacttaaaggagagttacaacaggtacaaagagcgaatgtactcacttatttttaaattctattaaataatatttaaattctattaaataatatttaaattctattaaataatatttaaattctattaaataatatttaaattctattaaataccgctgttcacatggaacctttccccacttcggtccttcaagttctcattgaagtatttgctactaccaccaagatctgaccgctgttcacatggaacctttccccacttcggtccttcaagttctcattgaagtatttgctactaccaccaagatctccactagaggccgttcaacccgggctcacgccctaggcttcgtcactgacctccacgtccgcctactcctcagggcatcgaccgctgttcacatggaacctttccccacttcggtccttcaagttctcattgaagtatttgctactaccaccaagatcttcactagaggccgttcaacccgggctcacgccctaggcttcgtcactgacctccacgtccgcctactcctcagggcatcgactgagttcaatactgctatcctgagggaaacttcggcggaaaccagctactagaaggttcgattagtctttcgcccccctgcccatatttgacgatcgatttgcacgtcagaaccgctgcgagcctccaccagagtttcctctggcttcaccctatacctagaattaccacggttatccaagtagtaaggtactatcaaataaacgataacttatataatgagccattcgcagtttctccgtataattgctttcgtaggagcctaagaacgcatgcacattaatatgagagccactatccacaaaagctggtaagtggatgtagatagaggctgaagaggaagaagcaagacggagacagctggctatgttggcataacatggcgaagtggggcgccacggattatctgcggcgcttcggctgtttgccggtcgagaggttatttcgtagcttaaagttagtccaccatccattagaaaatgtaaaaatagctgcacaattggggtatttcatgaatgaaccatcgccggcgcaaggccatgcgattcgagaagttatcatgaatcaccagagagccccgaagggcattgggttttaatctaataaatacatcccttccgaagtcgggattttaagcatgtattagctctagaattaccacggttatccaagaataatatttatctctaagttttagtaattacttatagtataaatagatataaaatataagcttttaatagcttactacagcaggcgattactctacggtactagaagtgtgctgtagtatttcgcgtattgtaattttaaaacgagcggggtcaaatgctttgcagacgacttagctgtgcgaaacggtcctgtaagcagtagagtagccttgttgttacgatctgctgagggtaagagcaggcgattactctacggtactagaagtgtgctgtagtatttcgcgtattgtaattttaaaacgagcggggtcaaatcctaagcagcaactgtaatgctatctttggtctggttattgttcgagtatagagcttcttgctcgataatgtctagctcgatactcttccaaatcgcgttcatacctcttcgcctgtttgttagacggtctttccttatctcctcagcaacccgcgcttctaagaccggtttgaagttggggtaccgggtaggcagaaaccacaaccagctaccctatacccggcgaactcaaaccaaatctgcataaccttcttcttcttctatattatagcttctagttagaaagctaataggttttttattagaattttcttctttattagaattaaattcctttgaaaagactgatatatcaagcggctgtaatacgtgcgatgaatgcgaaggtaagaaaagaaggaatatatcattctggaagcatttgatcataaattcatcacctatactcaacataacctacactttacataacctgcacctcacatgacctacactttacataacctgcacctcacataacctatactcaacataacctacactttacataacctgcacctcacatgacctacactttacataacctgcacctcacatcacctgcaccccacaggctatctcaccgcctgtagctcacgctcagtagaccggccctccctgtatctagccactgtcctgaccggcttccctttcgccacacggcgcaaagtgcgcctttgaaacggaacttccctatggcttaggatcgactaacccccgtccaaccgctgttcacatggaacctttccccacttcggtccttcaagttctcattgaagtatttgctactaccaccattgattttccgcaaaattcatttgtatgggaaatcaaaaaaatcgactcacggccaccaaaccgcgcgaccgatatacaagactttttcggcttagcgtcttagcaggcgattactctacggtactagaagtgtgctgtagtatttcgcgtattgtaattttaaaaagagcggggtcaaatgtctacagtagagtcaatagcaaggccacgacgcaatggagaaagacggagagcgccaacggcgtccatctcgaaggaggcgccagcgataaccggagtagttgaaatggtaataagacgaccaatctgaccagcaaggaagccaagatgggaaaggtcgtattttgccttcaggttgcgtacgagagtaaaccaaggtctaataacctttggatcttcgcatttggccctctgatagtcccgaggcttgttctcacatttccgtccagtaactctgttctccatctggccctattcgtgccttgggaacgcttttttccgacatgcacggcgatgttgccgatttatggctcggatacgaagcttctctctgtcaccggctacgttttcacgtatccatgccagaaagcggtgataccacccgcacgtacagatggacaagaataggcttcggcttagcgtcttagcaggcgcttactctacggtactagaagtgtgctgtagtatttcgcgtattgtaattttaaaacgagcggggtcaaatcctttgcagcgccctcccatgagcctgggtactcttcagaaatacaccggcccacatttaccctcttgcacgccacggtcagttcccgagccagttttgattaggctccttctccggggtcgagccctaaccctccgttacccgttgcaaccatgtttggccaatacccaaacatcgaaagtaggctccttctccggggtcgagccctaaccctccgttacccgttgcaaccatgtttggccaatacccaaacatcgaaaggtgatagggaagaaatttgaatgaaccatcgccggcgcaaggccatgcgattcgagaagttatcatgaatcaccagagagcgccggacggccgaagcctgctaagggcatcagcacccaggtgctggctgccgccggccggttgcccggctagtggctgcctctagcgatacgactaccacaagagtgtgccggagtcgttcacgagttttcgcgtgtcacagtctctttgcccttcaacatcggtataaggccctgccccacctgcttcactgctcctggcacctagcttctctcggttcttcctgtcttgaggaccttcgaggagatgatgaacgacaccgaggcgctgtctgcggcctttgacgccgagtccaacttcatcgcgtactgctgccaagtccattcccacacctacacctgcatcaagtattccctgaagggcctcctcttaagctgatcagttgagtatagatattgaatatcttatctttaaagctgaaggaattattcaagatctaagacctagtctagggtagtatttgcgctctgcccgttgggcaaattcattaaactcagcctgcaatgggctatatgcgatacagatccccagactgtacttcggaagctcggcgaaaacagtactcgagagccttataaaaagactcctattacttactatgataccaatcctccatcctatagctccaatagcgtatattaaagttgttgtggttaaaaagctcgtagttgaaccttgggcctggctggccggtccgcctcaccgcttgaaccaatgaaaaggcagcctgttctcgcataggctgcgaaaaccccttttaaattccgcttatgcagttgaattttctctaggacttacctatgagcagaaactcccgagggagccacattcccaaagcctttatcccccggggcgaactgatgctggcctgggcaggcagagtgcaccgcgggtgccaatgaaaccacatcattgatgaggatatgagcgcccgctttcagagctcctatatgtgcccgcagtatctcaatacaacgaatggccaccaaaccgcgcgaccgatatacatgactttttttgaagtggtggtcagaataatcagcttcgcgagctctttgacatactggccttctcacttccctccgatccgcgtggaaggcgggagaccggtttgaagttggggtaccgggtaggcagaaaggccatttcattgttgcctcaacaacggcctcggacgcctgacgatatgaatagaggcgcccaagacaatgacggagttcgcacctagaatcgatccaaggcaaacaaatatttctctgctagcttattcaagagctacccctcccgtcattcgggaagggccgacgaacaagatgccccaccacctgctctacaggatgccggattagacactcaagcacacaacgtcactaggttcactagtctactgagcgtgagctacaggcggtgagatagcctgtggggtgcaggttatgtgaggtgcaggttatgtaaagtgtagggcatgtgaggtgcaggttatgtaactagcctctgtgaaactccttcgacgagtcgagtagtttgggaatgctgctctaaatgggaggtatacgtcttctaaagataaataccggccagagaccgatagcgcacaagtagagtgatcgaaagatgaaaagcactttgaaaagagggttaaaaagcggtatgataggaagagccgacatcgaaggatcaaaaagcgacgtcgctatgaacgcttggccgccacaagccagttatccacatcacctctgtttactttacatgtagataggcgaatgattggtgggcatagagtagaaagctcagctagttaatagtatggagaaatcattagcgcacgtctatcccgcaaaggcgaacctatagccatcatgcatgccctggagtaatgcctggagtgtcattctactaagggggagtcctcggacaaatacaaatgcagaggaacgtcgaagggggggggggttagcggaattgagctggggaccgtggccgaagcggctgacgacggtgtctggcgagagagagggaagggtcgagcagaatatggcagagatgcttttggtgcgtgctgatggcgatgaagtcgccccataagatggattaaatccgtctgcggggtgcttccgaaaataatggactgaacatctgccccaataaagttcggcatgtaatgcccagcacctctgctgggtctggtgcgctctcgacgtcccttgaaaatccgcgggaaggaataattctcacgccaggtcgtcccgctgaacttaagcatatcaataagcggaggaaaagaaaccaacagggattgccctagtaacggcgagtgaagcggcaacagcatcgaagacgatcagataccgtcgtagtcttaaccataaactatgccgactagggatcggacgatgttaaaaattgactagttcggcaccttacgagaaatcaaagtgcttgggtactatcaaataaacgataacttatataatgagccattcgcagtttcgccgtataattgcttatacttagacatgcatgcctcccccctcatgctgccagcggcgaacgtcatgccacatcttatcgtaacggccaagcttcctctgtatgtggcagcacactgcacaaattgtaggttgttcttcggtctcatagaccagcatgaggccacaagtctggcctatgcggtattcccgtttatggttaagactacgacggtatctgatcgtcttcgatcccctaactttcgttcctgattaatgaaaacatccttggcaaacgcaggtgtcctaaggggggctcatggagaacagaaatctccagtagaacaaaagggtaaaagtccccttgattttgcttttcagtgtgaatacaaaccatgaaagtgtggcctatcgatcctttagtccttcgacgtgtgaagctagaggtgccagttcatttacattacttccctgtttacttgccaccccaagacctcggtatcctgctcagaagttatcaagcctcatcatagaatgcctcctccagcccaaggacaatatttcagctataccaataccgtacggggctctcaccctctatggcgtcccgttccagggaactcggaaggcacgtcgccagaaacatcctctacaaattaaattcagcccacgtgatgccatacaacgagtacttgatggcagacaaggcccgagtctcaaggagcaggagagcatcctaccatacgttacaccgccgtggtggcaaggtccaaaaatttacatcgaggaaaccgcagacagggcaatcgctagacacagtgtgctgtagtatttcgcgtattgtaattttaaaacgagcggggtcaaatcctttgcagacgacttagctgtgcgaaccggtcctgtaagcagtagagtagccttgttgttacgatctgctgagggtaagccgtccttcgcctcgatttccccaatatgggcatgggggcgaaagactaatcgaaccttctagtagctggtttccgccgaagtttccctcaggatagcagtattgaacgtgtgttgtgtgtgaatatgctttggtggcattcccagtgaggtgcatgtgctgaagtttggttcccggcgatgtgcatgcgtcgtctccgcgttcagttgcgttgccgcgcaaaacccacatccaggtgccggaatattgaccggcttccctttcgccacacggagggaagcgttcatgaccagacttgggcaggttgatcatccgtggttctccgcggtgcactctgcctgcccaggccagcctcagttcgccccgggggataaaggctttgggaatgtggctccctcgggagtgttatagcccactgtgtaataccctgggaaatgtgggccggtgtatttctgaagagtacccaggctcatgggagggcgtcccgcgggcgctgcagggtatgtaaaataaaaaaaatgtgggccggtgtatttctgaagagtacccaggctcatgggagggcgtcccgcgggcgctgcagggtatgtaaaatgaaaaaaggtatccggttcatccttgcgtttcctctttgtagacctgcgtgatttttcacaagctacatttacgctagtctccttatcttcgcggctcctcggtgaataatcgagcaattcttcacgaaaggtctctgtgctgctcccttttcgctcactgaaagatcggcttcggcttcgctggcgggtgattcatagtgggcgtcgaccctcacgaaagcggccgcgtgcggtacgtcgtactggggatgcctggtctggggagagctctgctctcgccggcgctggatgggttctgtggatggatggccgctggctaaacttacggcttcggcttcgctggcgggtgattcatagtgggcgtcgaccctcacgaaagcggccgcgtgcggtacgtcgtactgcggatgcctggtctggggagagctctgctctcgccggcgctggatgggttctgtggatggatggccgctggctaaacttatgagaagttgaagaagttcggatttcaaatatatgcttgtattgacgcgtactcaaggtgtataatttggttctatattggccgatcagcaacaacctcgatgagcacattgaagtataggttatgtaaagtataggttaggtggcgtgtgttgtgtgtgaatatgctttggtggcattcccagtgaggtgcaggtgctgaagtttggttcccggcgattcagtaactaattctccagtgcccctcgtgggcgctggtggccaaccccggcgaacgatagttacctggttgattctgccagtcccgagacgctgtgagtggtttgctgcagcgccttaggctttcgccttcagcactcgcgcccctctctcataggtgcacccccgagacgctgtgagtggtttgctgcagcgccttaggctttcgccttcagcactcgcgcccctctctcataggtgcacggacccacatttaccctcttctgacttagaggcgttcagccattatccagcagatggtagcttcgcggcactgcccggtcggacagccgcaaaaaccgattatctgaatgagcggttcctctcgtactaagctcaattaccattgcggcgaggtcatcagtagggtaaaactaacctaagaagcagccgatttcttccagatcccgcaacgcacgattggacagtgggttcgtcagaaggatgagattatccaaggtaagcctcctcattacagcccgcagtggccgttgcttgaagaagctctcatgaaggaattccaccaggctaggaagctaggtaggctacttcacgatcgagattctgcagcgcttcgatagccatgttgaagtacggcagggccttctcgacaaacttccaacgagaaaatctctccgtgtcgcttttgcaatcgtcatgcgctacatgtgtcgccgcaaaaatcactaagccagcgttgaacgcttggctccccaacaccacgccctaggggcatgagggttgaaatgacgctcagacaggcatgcccgccagaatactggcgggcgccatgtgcgttcaaagattcgatgattcactgaattctgcaattcacattacttatcgcatttcgctgcgttcttcatcgaagtcaatctacgaactagattgtcgatgttgaatgcataaccaccctgccgagcccgggctcggaccgacgcttacactctccaaaacagatctcacctacgattagcgcttaggtgagactgaagtaacgaggaacttctaaacatgctccgcagctcaatccgtcagaccctccaacgcatcttggaaagcactggctggagggctttttaaaacggaacccggaaattaagaccttacgaggcaagcgaatcgatctccttcgtattaatggggctacagctgaccgggtgaaggatttcttcgcaataatgaactatccggctattaaacagctagcgattacaaccactagcttatagcggttgcaaccactagcctctagcgattgcagccactggctacaatcgctaataaccccctcagtcatgagaatcataaagccgctgtatggaatagccgaatcgggcgtgcattggtatgccacataccacaagcacttcacaacgcgtatgaagatgacgacctctagctatgacccgtgcctcctgatcgcaggaagtgacgcgctcggcttcgggcttatcgggatgcaaactgaccagtcatgagaatcataaagccgctgtatggaatagccgaatcgggcgtgcattggtatgccacataccacaagcactttacaacgcgtatgaagatgatgacctccagctatgacccgtgcctcctgatcgcaggaagtgacgcgctcggcttcgggcttatcgggatgcaaactgacgatacgctcggattattcgacgaggcacttgctgcagaggaagaacaccagttagcagaggccaagttcaaggcaaaagccagaatccaacttgcagagggtactccccctggagcccaagcactttgatttctcgtaaggtgccgaacgagtcaatttttaacatcgtccgatccctagtgcccaacgtacccaacccttagagccaatccttatcccgaagttacggatctattttgccgacttcccttatctacattgttctgcaactcaagcttctctgcctcctcccaccggccttgattccaatatgttgatgcaagatcggccatactcgtcagtgtggagggatggtctgctccaagcttcatcttactcgtctccatcacctgcaacccaagcttctctgcctcctcccaccggccttgattcaggctatataataaagtaatagactaagtagatatagctactggatctataatattaaaagcagctttattactataagtagctgatgctggcctgggcaggcagagtgcaccgcggagaaccacggatgatcaacctgcccaagtctggtcatgaacgcttccctctcagttttatgaggtaaagcgaatgattagggacccgggggctatatattgccttcatccattctcaaactttaaataggtaagaagctcttgttgcttaataagccgggtttggccaagctgaaagccctgacaggctaagcagcgacctcttttcttcctattgacatgattatgctgtaatacaggcttattttcatccccagttttgaatagctctcttgagctgccgtcagaggcataagctgcaaagaagctatcgcaaacctgctgccgccacgcccgttggtctgtataaggactgaggttcgcgctctgcaaggatgctggcgtaatggtcatcaacgacccgtcttgaaacacggaccaaggagtcgtctattccaaaataaaacaagaattaagtttcctaggcgggcgcctgatccggggcacacgaggcgcccggggcaatcccgccgaacaatcccatgagagagtacttgcctgatccggaacaaatcgggcacttcgacagctgatcaacatcatgaggtggtctagcccctgaatcttcagaaatacaccggcccacatttaccctcttgcacgccacggtcagttcccgggccagttttgattttccgcaaacttcatttgtatgggaaatcaaaaaaatcgactcacggccaccaaaccgcgcgaccgatatagcatagttcaccttctttcgggtccggccccgtatgctcttactcaaatccatccgagaacatcaggatcggtcggagaggcgccgaagctctctcctacgttcactttcattacgcgttcagaaatacaccggcccacatttaccctcttgcacgccacggtcagttcccgggccagttttgattttccgcaaaatgcatttgtatgggaaatcaaaaaaatcgactcacggccaccaaaccgcgcgaccgatatatagggacagtgggaatctcgttaatccattcatgcgcgtcactaattagatgacgaggcatttggctaccttaagagagtcatagttggttcctgggtcttttctttcccggtttgatcacggtgcatggaaccatgggtatctggaatgcgattcgggggtggagatgggttagcttctttccgaggatgataccggttggtttctacaaccggattgttccgagccaattggttgatcttggagtctcttggtcctcaatgaactacctcaagactcaacccgcatttaccttaccctcttgcacgccacggtcagttcccgggccagttttgattttccgcaaaattcatttgtatgggaaatcaaaaaaatttcggcgggattgccccgggcgcctcgtgtgccccggatcaggcgcccgcctaggaaacttaattcttgttttattttgtaatcttctgagtagtttttacaaataaataaaaactttcaacaacggatctcttggttctggcatcgatgaagaacgcaatttgacgatcgatttgcacgtcagaaccgctgcgagcctccaccagagtttcctctggcttcaccctatacaggcatagatttgacgatcgatttgcacgtcagaaccgctgcgagcctccaccagagtttcctctggcttcaccctatacaggcatatctgcgaagtagtgatattccgcatcggagagcgacgagcccctgccgttaaacccccaactttccaaggttgacctcaggcctattttattattccatgctaatgtattcgagcaaaggcctgcctggagcactctaattttttcaaagtaaaagtcctgtgaagtcataagaagttgaggcctagacgctgaggaaggaggacgtaataaagagcatagcgcacgtatccgtaggatgctacctggacagggaaaaagagcaccaggtccgttcaacagtacgcccacgatgggggaaggaagtgagcttggaaaagcaagatatccacacaagcgcattagcatggggttcgatcgtccatgccagtggtctatcactgtcgggattgcatacggcagactgcagtatcgtatcacatactgacggctcttaacaacttttttgattttacataccctgcagcgcccgcgggacgccctcccatgagcctgggtactcttcataaatacaccggcccacatatatatatataaattaaatctatataatataaactatatagagaacttaaactagttttagtattagaataactataataattaatattctttaattatattattaaactattaaaatctcatggaaaaagcaaacctattcaccatttacgttaattggtccattcaattgttcgagtatccacatcggcagggataatgaatgaagtttattacgcccgggaggatttacctcatagggcccagtgcttttagctacgtacacttcgacagttttcatcagctccaaggtcaaatggcacagcacttaaccaggccagatcgatctgttcattcatccacgaggtcgtaaggttccccccctgatcagggagtctatcatgattgtccggtatttcaaatacctcgcctaaggcgggcggagggtatgcgttgctgtctcctggccatacctgattgtgatgcagctcggaaatctagccaatgatgagcggcgtcgggtgcggaaattctgacagcctatcgggggtgcggataatggatggccgactgcgtggcggatggatattgactttaactaatgttccggtaaacattgatgaggacagaaattgacgataaccgagtggacaacaacccttgctgccctggcctgtaggctctccagctttgctagagtatgtttggtatagggagctccgcatgttcgccagttactgttggaccatgccgagcaagcatacatgatttggggtatcaccacgcttctatatgccttccttaagtctttacctatactcaacataacctacactttacataacctatactcaacataacctacactttacataacctgcacctcacatcacctacactttacataacctgcacctcacataacctgcaccccacaggctatctcaccgcctgtagctcacgctcagtaaccttatataactaacttttcttatttctaaataagtataattttagattaaactaaaataaactctaatatactaatattacacagacctgttattgcctcaaacttccatcggcttgagccgatagtccctctaagaagccagcgtactgccaaagcaaaacgggctagtcccgtcttgaaacacggaccaaggagtcgtcttcgtatgcgagtgttcgggtgtcaaacccctacgcgtaatgaaagtgacccgtcttgaaacacggaccaaggagtcgtcttcgtatgcgagtgttcgggtgtcaaacccctacgcgtaatgaaagtggatgcaccttacatcatataccgacgccactatcctatcgactaatttgccgcatgcagtcgcagatcagatgggttacgctagtattatcaaagcatggctgtgagtggtttgctgcagcgccttaggctttcgccttcagcactcgcgcccctctctcataggtgcaccgacccacctttaccctcgtgcacgccacggtcggttcccgggccacttttgattttccgcaaaattcatttgtatgggaaatcaaaagtatagaacttaattaccctatctataataaagaatttatagctattatatatatatttaaagaatttaaatactactatttagggataatatataaggttaagatatatatagattataagaatatttaatattttactataacctagtaacttaatagaagataaatctattatactaaatacttatcctaatttaattataaaataatatattaaaaagaatcagaaaatagaagagctaatacccttagctgtaaaccggaatataagtaaactatatctaagataaataggtagttacttactataaataataaagaatacttagtataggggaaccgaccgtggcgtgcacgagggtaaatgtgggtcggtgcacctatgagagaggggcgcgagtgctgaaggcgaaggcctatgagagaaattagtataattttctgatctctctcacaaaaataagattcttttgcgctatattttgcactatattaggttcactctggattactagtaagctattataagcccctagtatatatatatatttattttattagatagaatactcttttagacagttattaatataattatctatatatctattattattgcccctcgtacaaacaaccaccagacttcatatacgtatgtaactgtggctcctgcaggccttgtgagccctacagcctgggataacatcagcgcggccctcttcgaaagcgccgccccagagaagagctcgtcgaagttatcacgagctgagcgatacgcccgacgcgacgcgcgaccttgaagatgggagcttaaattgtactcattccaattacaagatccaaaagaaccctgtatcagtatttattgtcactacctccccgagtcgggcttgggtaatttgcgcgcctgctgccttccttggatgtagtagccgtttctcaggctccttctccggggtcgagccctaagtactagccctgaaaatggatggcgctcaagcgtctcacccatacctcgccctcagggtagaaacgatgccctgaggagtaggcggggccaccgtccaactgtctggatgtactaacaccttttgtggtgtctgatgagcgtctactctggcaccttaacctcgctttcggttcatcccgcatcgccagttctgcttaccaaaaatggcccactagtattgatacattcgaatgctcacgttcaaccggtcggacagccgcaaaaaccaattatctgaatgagcggttcctctcgtactaagctcaattaccattgcggcgagggcatcagtagggtaaaactaacctgtctcacgacggtctaaacccagctcacgttccctattagtgggtgaacaatccaaggaagtcggcaaaatagatccgtaacttcgggataaggattggctctaagggttgggtacgttgggctttgggaggacggctcgggagcaggcagccactagccgggcaaccggccggcggcagccagcacctgggtgctgatgcccttagcaggcttctgtcctcaccgtgattaagcccccactctcgggaaagcatcaaaagatctatcgaagtataatattgtttcaggccgtctctttccgtagggtatcgttagaactatatatcgggcctggaaccatctaaaaggataaacgttcaattttcagtgattaacatcgctccggtgatggagagtgcgcttgaaggacgtatcggccctttctcttctcaggtcggggggaaccactggcgcaagaaatcctggtgcgggcgctgtggtagcaaaagcccactgaataggctcacatatagaaaggcgaagtgacggcgatgccgttcttcaagttgggactcgacgaacacaatgaggattgacagattgagagctctttcttgattttgtgggtggtggtgcatggccgttcttagttggtggagggatttgtctgcttaattgcgataacgaacgagaccttaacctgctaactagcccgtattgctttggcagtacgctggcttcatcagacaccacaaaaggtgttagtacatccagacagttggacggtggccatggaagtcggaatccgctaaggactgtatagggaacgtgagctgggtttagaccgtcgtgagacaggttagttttaccctactgatgacctcgccgcaatggtaattatagggaacgtgagctgggtttagaccgtcgtgagacaggttagttttaccctactgatgacctcgccgcaatggtaatggagctccacagacacgctcgtgacaaccctttcctttcaaccacccattgcgcccgcaattttcaagtaaaatgcgtactttgggtgacgaaatatccggtaatcgccgtcgaggctgccaattttctcccgaagcaaaaggagcgatgcttggcatgttactcgagacgtaaccacattttcaaagtgaaggtgctcatcaacccaagctttgacaagcttctttttgtgtagatcaagccatgtttcgatgatgtaggcgatttcaacccggacgtgtcgctgatgaagatcgtcgatcagtcgtgtgattttatggaggaggtatgctcctgactttcctttgggcttggccactgatcgtatcgctgcctgattgtctgtgtatattcaccttttcggattcttgccctttctgcaacctgccttggccagaggccttcgatcttgaagcaactaacgtgactccacggcggcagccaaataatcgctcatcttcatctcagaggggttcttcttctcggaggggctcgtcttcatatgcccttaggtgttctgggccgcacgcgcgctacactgacggagccagcgagtactcccttggccgaaaggcctgggtaatcttgttaaatcggtttgtccggagctagggtttaatggccggaagagcccagcacctctgctgggtctggtgcgctctcgacgtccctatcggtttgtccggagctagggtttaatggccggaagagcccagcacctctgctgggtctggtgcgctctcgacgtcccgtgaaaatccgcgggaaggaataattctcacgccaggtcgtactcataaccgcagcaggtctcccgctgcacgtggcgatctcccgttgctcagtggtaagtttagccagcggccatccatccacagaacccatccagcgccggcgagcgaatctttgaacgcacattgcgcccgccagtattctggcgggcatgcctgtctgagcgtcatttcaaccctcatgcccctcagcacccaggtgctggctgccgccggccggttgcccggctagtggctgcctgctcccgaggcgtcctcccaaagcccaccgtacccaacccttagagccaatccttatcccgaagttacggatctattttgccgacttcccttatctacattgttctatattttgccttcaggttgcgtacgagagtaaaccaaggtctaataacctttggatcttcgcatttggccctctgatagtcatatttccgaacccagcgcgtaaaagttgggggtttaacggcaggggctcgtcgctctccgatgcggaatatcactacttcgcagaggaggccacgacgggtccgcaaagttgggggtttaacggcaggggctcgtcgctctccgatgcggaatatcactacttcgcagaggaggccacgacggggccgccactagatttaggggccggccgtccctcgcgggctttggccgatccccaacaccacgccctaggggcatgagggtaaagttgggggtttaacggcaggggctcgtcgctctccgatgcggaatatcactacttcgcagaggaggccacgacgggcccgccactagatttaggggccggccgtccctcgcgggctttggccgatccccaacaccacgccctaggggcatgagggtcgcacggcaatccaccttccccctctcagttccccagggcatccttccaccacaccaagaccactagggccggtgcggctaaaacaataatttaccgcggctcttaacaacttttttgattttacataccctgcagcgcccgcgggacgccctcccatgagctcgcatggccttgcgccggcgatggttcattcaaatttcttccctatcaactttcgatgtttgggtattggccaaacattgttgcaacgggtaacggagggttagggctcgaccccccttcaagttctcattgaagtatttgctactaccaccaagatctgcactagaggccgttcaacccgggctcacgccctaggcttctaggggatcgaagacgatcagataccgtcgtagtcttaaccataaactatgccgactagggatcggacgatgttaaaaagtgactcgttcggcaccttacgagaaatcaaagtgcttgggctccagggggagtatggtcgcaaggctgaaacttaaagaaagtagatagatctcagccttcataagagcccataggttctcaattggattaaggtcaggcgagtaaggtggccagatcataacctctatacagtcttcaataaatccaagaatttcacctctgacaattgaatactgatgcccccgactgtccctattaatcattacggctgtcctagaaaccaacaaaatagaaccacacgtcctattttattattccatgctaatgtattcgagcaaaggcctgcctggacccgtcttgaaacacggaccaaggagtcgtcttcgtatgcgagtgttcgggtgtcaaacccctacgcgtaatgaaagggaacgtaggagagagcttcggcgcatctccgaccgatcctgatgttctcggatggatttgagtaagagcatacggggcctacttagacatgcatggcttaatctttgagacaagcatatgactactggcagaatcaaccaggtaactatcgttcgccgtggttggccaccagcgccagtctatctttacatcccgcacatctccttctccagtatcttaggcgatatagccttcagggtagcttagaagagatgggaaagcctaaggcgctgcagcaaaccactcacagcgtctcgggtcaactgtaacaagctggtccgatccgctgtgggaaagctcttcaactgtaccgtatcttgcagattcccactgagtggtcacttggacaggctagacggcttcggcttcgctggcgcatgacctacactttacataacctgcacctcacataacctgcaccccacaggctatctcaccgcctgtagctcacgctcacatgacctacactttacataacctgcacctcacataacctgcaccccacaggctatctcaccgcctgtagctcacgctccgtagaccggccctccacccgggggctatatattgccttcatccattctcaaactttacatatgtaagaagctcttgttgcttaattgaacgtgagcattcgaatgtatcaatactagtgggccatttttggtaagcaaatcttctgagtagtttttacaaataaataaaaactttcaacaacggatctcttggttctggcatcgatgaagaacgcagcgaaaacccgccagcgaagcggaagccgtctagcctgtccaagtgaccactcagtgggaatctgcaagatacggtacagttgaagagatttcccacagcggcgttcttcatcgatgccagaaccaagagatccgttgttgaaagtttttatttatttgtaaaaactactcagaagattcgaaaataaaacaagaattaagtttcctaggcgggcgcctgatccggggcacacgaggcgcccggggcaatcccgccgaagcagtatcgtatcacatactgatcaatatactttttcggccaacctctggcagcggcaatcccaggcgcttgcttcatgatttgagattcactgacttggatgatttctctctgttaatatagcgccacagtaagcggataattggcacggtgggtcactagatgaaaccttgaggggaggtaagccctcgacgcaaactcagcacgactacacggcgcctttcaagcggacaacatggatgtcgacaaccgtgaatgagcggcaggaaatcactctcaatactacagtacaatgtcaggaaatcaacgtcgtcatggtcctgcgcggcgtcctgcccaaccgcccgctcctctatggtctcttcggcaacatgtacctcgcgggtaccatcatctttggcggcggccccgtcgtgattccgctgctccgcgagtatatagtataaataactatatataaataggtatcagattaatattaaatctatattattcctaataaaaaccttctatagtagtaaatatatactatacttatagaggccacgggtacaaacggaagaatctagctctcagaaatcacaaccagaggggagaaggacgtccctcagacccagtcgatggcggcagagtctccgagaggctcaacggcgaagtcagaggcacgaccagcgtcagacgccgacagcaacagcaggacgtagaactgccttgttggcatgccaaaggcatagaagcgacaccgcagccgggaagcaatgagatactgcattcatggaggcgagacagcggtctgtaaggatcacagatggcatccttgcgccacaggcttcgtacattgaacgtagccgatctaagtttgagaatggatgaaggcaatatatagcccccgggtccctaatcattcgctttacctcataaaactgagttcaatacttctcgacgtctagtgccgggcccgaggttgctctgaacgcccctgatatcacccttgctgccctggcctgtaggctctccagctttgctagagtatgtttaatcaattagaatatccttcttcgcaagctcctcgcgataggctctcttgaccggcgaaaagactgatatatcaagcggctgtaatacgtgcgatgaatgcgaaggtaagaaaagaaggaatatatgagagtgggggcttaatcacggtgaggacagcttatctcaccattgctgatgtttcagaatggttctcatacgtctacgcagtctagaagcttcttttgctgtcgcttatggaagttggtgataatatagatatatctttttctgccagtggcctagaattatccctctcattgaggctatgtggccgccctgaacgcggtcgacttttcgcgctttgttgttgcttgtagcgatagtgtatgttatagggagaagtgtaaggaggagaagtgtaaggaggagaagtgtaaggaggagaagtgtaaggaggagaagtgtaaggaggagaagtgtaaggagcagtagtcatatgcttgtctcaaagattaagccatgcatgtctaagtataagcaattatacggcgaaactgcgaatggcgcattatataagttatcgtttatttgatagtaccttactacttggataaccgtggtaattctagagctaatacatgcttacccgggttgaagacattgtcaggtggggagtttggctggggcggcacatctgttaaaccataacgcaggtgtcctaagggatacctagactggaataaggcagaagataaacgtgtagaagcgcgggttgctgaggagataaggaaagaccgtctaacatacaggcgaagaggtatgaacgcgatttggaagagcatcgagctagacattatcgagcaagaagctctatactcgaacaatgacgctttgccaaatgacgctttgccaaatgacgctttgccaaatgacgctttgccaaatgacgctttgccaaatgacaatttgctgaagacattgtcaggtggggagtttggctggggcggcagatctgttaaaccataacgcaggtgtcctaaggggggctcatggagaacagaaatctccagtagaacaaaagggtaaaagcaaccaacgtactgatccggccgggttattacagcgcaacccgactccttgtcgacctcatagttcgaataagcatgtccatgaccgtgatgataagtggcatcgtcagcgaagactcgataataatccgccttccacgcggatcggagggaagtgagaaggccagtatttcaaagagctcgcgaagctgattattctgaccaccacttgagcgtgcacaatggcaccaccaacacaaaccccgcctgcagtgcctcccttcgaatgcgacgaagcagaagaggtcttcaacacaaccaagctgacgaaggcctgtgtaaacagatggcgtcccgttccagggaactcggaaggcacgtcgccagaaacatcctctacaaattacaactcgggcttgcgccagctttcaaatttgagctgttgccgcttcactcgccgttactagggcaatccctgttggtttcttttcctccgcttattgatacatttggactgctccgcttcctcctgagactgagctttctcgccaaatgacgacttctaccacatctattgacattatgggtctgcaagctgcttatgctaatttgcatactgaccaagaacgtgattacttcatgcagcgttaccatgatgttatttttgttacacagtccttagcggattccgacttccatggccaccgtccaactgtctggatgtactaacaccttttgtggtggctgatgagcgtctactctggcaccttaacctcgcgttcggttcatcccgcatcgccagttctgcttaccaaaaatggcccagtctatagcagtcagctaagctcatttagaatcagaacttagtatactatattaggctctctatatatatacaagagggaaggggagaaaaggtatataacctccccttctgccattgattcaggcttttaattttctaccatcaatcatcaaatatgaggagagagcatttaagcgtgaattttcggacatttggaccttgctcagagagtcctatgaccctacggcttgatgtggttggttggttggttggttgtattcctactcggttttagccgccacttaacagcagccatgcccggctagtggggtttttcttcgttttccctcgttggcgactcgtccccaaagttgactctcttctgggctctcttggccggcgacttgctccgtccagcccttgaatcaaaaaaatcgactcacggccaccaaaccgcgcgaccgatatacatgacttttgtaaacccgccatcccatctcttctatcgataatatggtgcgcaagctggaacggcgggtgcagaccattctcgaataagcaatggcaagaaggctccgctcattgaaactgagctcaccacccgcgctgatgacttccttcaatcgataatatggtgcgcaagctggaacggcgggtgcagaccattctcgaataagcaatggcaagaaggctccgctcatcgacactgagaaatgctctacctcccctgcccccttcctgacccgctctgcactgagccatatacccctaacaccctgctgctgctgccggaatagcactcgtgtgcttattatccccccttcctctccatcatctcgccctaaccctgttgcctcagcctgggtatagatattaataccttaaaaactctaataataggagctatttatacagctagatatataaataacctagctatagctatagccgtactgaggcattccggcacctggtgtccggctcgcgcctcctagcctcgttgatggatgtgtctccgatttcctcaccccctggaaagtccctgagggagattgttcaattaagcaacaagagcttcttacatatttaaagtttgagaatggatgaaggcaatatatagcccccgggtccctaatcattcctttgcagacgacttagctgtgcgaaacggtcctgtaagcagtagagtagccttgttgttacgatctgctgagggtaatcctttgcagacgacttagctgtgcgaaacggtcctgtaagcagtagagtagccttgttgttacgatctgctgagggtacgccgtccttcgcctcgatttccccaatacaggcggccctggtggctggctgcgtagggggtttgggagatggattacaacagccatagcgtgtatcaccccgctaaaattccaaccccagcgcacccaacccactacataatcaaccacagcgcacccaccagccatagcgtgtatcaccccgctaaaattccaaccccagcgcacccaacccactacataatcaaccacagcgcacccccaccaccacaaatccaaccacagcgaatgcacgccactgtaaattccaccacagcgtgcatgcaccaccacaaatccaatccgcaaaattcatttgtatgggaaatcaaaaaaatcgactcacggccaccaaaccgcgcgaccgatatacatgactttgtttgaagtggtgactagtcacgtctccttttgctatctctcatcatttgctttacccttatttgttctttcctgtcttgtcctattttcccccgtcttcctttgctttatctcttccggctttccggctgtagaaacgttcatattcctgccggaaagacgacggatgaacggcgtcgatgggcaagctcacatcgtgtagaaaacgatccaccagacggtcaacggtggcccgttggcgcttgcggctgtccgaccgggcagtgccgcgaagctaccatctgctggataatggctgaacgcctctaagtcagaatccatcctccagtttcgaaaccataacaagaaggtcaatcacagatcgaccgccaaagacccatcaaaagacgtcataagatcaatgatgttaacagctctatttatatatatataactataaagataataataataataataaatctaactattatcttaatagtataagctttggttgttggttgttggttgttggttgttggttgttggttgttggttgttggttgttggttgttggttgttggttgttggttgttatttattttctattaaattactagattatagtaaaatattaaatattcttataatctatatatattttaattttatatattatttctaacaggcatagttcaccttctttcgggtccggccccgtatgctcttactcaaatccatccgagaacatcaggatcggtcggggatgcggaccactcagtgggaatctgcaagatacggtacagttgaagagatttcccacagcggatcggaccagcttgttacagttggaccactcagtgggaatctgcaagatacggtacagttgaagagatttcccacagcggatcggaccagcttgttacagttaccgtagcggttatagcgggctgtagccactgacccacagtggctgcagccgctattggttagtgatcgtaatcgctatcagatagcgatcgcagttgccatattgccaaaacagctcttgaataaccgagcgttagcttctgtaaatactaaccagaaaaaaaaggggggtaggaagccggaaagcaaggcaaaaagtcataaaaaacaacacacctctacaaggcatagagtcgctatacgtttgatgagggtcgtgatcccagttgattgtgggtcctcagaggcttggagacgaacttggtatagctgttgcaagaaaggatgccactatagcccaggcaattgcttcaagcgaagcagatactagcgatgtcgttctgagcgaagtgatgtgaatggcaaagataatatccatacaaatggtagcgatggtcgcaacgttccctattagtgggtgaacaatccaacgcttcccgaattctgcttcggtatgataggaagagccgacatcgaaggatcaaaaagcgacgtcgctatgaacgcttggccgccgacggcgggggccccaggcagagttctcttttcttcttaacggtctatcaccctgaaatcggtttgtccggagctaggggttaatggccggaagagcccagcacctctgctgggtctggtgcgctctcgacgtcccttgaaaatccgcgggaaggaatatttcacctctgacaattgaatactgatgcccccgactgtccctattaatcattacggcggtcctagaaaccaacaaaatagggtttggtggccgtgagtcgatttttttgatttcccatacaaatgaattttgcggaaaatcaaaagtggcccgggaaccaaccgtctggccggtatttagctttagaagacgtatacctcccatttagagcagcattcccaaactactcgactcgtcgaaggaggttcacagaggctaggcatccaaccgtacggggctctcaccctctatggcgtcccgttccagggaactcggaaggcacgtgtcatgtatatcggtcgcgcggtttggtggccgtgagtcgatttttttgatttcccatacaaatgaattttgcggaaaagcaaaagtcatgtatatcggtcgcgcggtttggtggccgtgagtcgatttttttgatttcccatacaaatgaattttgcggaaaaacaaaagtgaaattaaattataaaattgtggcctgatttctccttatcggtagaaactaatcggtccgactttcctccttgaataaccctccgctggttcaccaacggagaccttgttacgacttttacttcctctaaatgaccgagtttggagagctttccggccctgtgcttaagttcagcgggtattcctacctgatctgaggtcaaccttggaaagttgggggtttaacggcaggggctcgtcgccacccgccagcgaagccgaagccgtctagcctgtccaagtgaccactcagtgggaatctgcaagatacggtacagttgaagcctatactcaacataacctacactttacataacctgcacctcacatgacctacactttacataacctgcacctcacataccctgcaccccacaggctatctcaccgcctgtagctcacgctcagtagaccggccctccctgtatctagccactgtcctccgtcgagagcgcaccagacccagcagaggtgctgggctcttccggccattaaaccctagctccggacaaaccgatttcaggccgtccggcgtacggttaacaaccaacttagaactggtacggacaaggggaatctgactgtctaattaaaacatagcagtgcgatggccagaaagtggtgttgacgcaatgtgatttctgcccagtgctctgaatgtcaaagcgaagccattcgaccatgaaggaccgaagtgggggaaggttccatgtgaacagcggttggacgtgggttagtcgatcctaagccatagggaagttccgtttcaaaggcgcacttttgaacccacttcccttggaagataataaggggaggaagagccacacctagggcattgatagattcaacagcagttactaaatcacgagatcctgactgcttcaggagggtgtattgcttccttgacgatcctagcaccagcccgttgcctctgactccctccatcatccttgcgtttcctctttgtagacctgcgtgatttttcacaagctacatttacgctagtctccttatattcgcggctcctcggactgaaaatcaaaatcaaggggacttttacccttttgttctactggagatttctgttctccatgagccccccttaggacccctgcgttatggtttaacagatgtgccgccccagccaaactccccacctgacaatgtcttcaacccgggtcggcccgcggctctccctgagcatccgcacttggattccgctattgcgggaatatgatttttattcaacgtgccacgtggggtcgagttgaaggattctcaagtacacagcattccggcccgctatcgataaggtccgcattatagaataggtaaaggatcggagagtagttagaaccctgaggtatgcctgttgtcagtcggtacggttctgacttgtagccatcaatagcgattgtggtgtatctttcctgagtacccaggctcatgggagggcgtcccgcgggcgctgcagggtatgtaaaatcaaaaaagttgttaagagccgcggtcaattattgttttagagggtgggaagcgctgtaagtcgaggacagtggctagatacagggagggccggtctactgagcgtgatgactacaggccattagcggcccctcaaaagtgtaaaaaaacgagctgtttctctccatgaactcgtgatctaccaacggcacgccatatcgggttctcgacagacgcacagctcactacctccccgagtcgggattgggtaatttgcgcgcctgctgccttccttggatgtagtagccgtttctcaggctcctctccacccccgaatcgcattccagatacccatggttccatgcaccgtgatcaaaccgggaaagaaaagacccaggaacccaagaacagcgccagcagcagagttgtggcctccgttgatcgccgtcagacagagggtgagagccccgtacggttggatgcctagcctctgtgaaactccttcgacgagtcgagtagtttgggaatgctgctgtcttcaacccgggtcggcccgcgaaggaccttaaaaccagaagttggacgtaaatccagccccgcttcattgaataattaaaaaaacaaagttattctaatactaaaactaatttaaattctctatatagtttatattatatagatttaatttatatatatatattattattatatagtataaataactatatataaataagtattagattaatattaaatctgtattattcctaataaaaaccttctaagccgtacgcggctttttttagctcttcggcgcttgcttagtacctcatttgccgtacgaagatcccggacctcagcacgtaaaagaatataatctgatatatattttttaagaatataattagtagtctatacctaaacctttaatactataagataaagttaaatattatacttgctgtatcgttgaattcaacagtaacgtcaggtgagtaaagatacccttcgttttcaaagatctgaccctcgggcttgctgtggaaaatgaccttcggtttcaaccgttggatcccatctgcgaagatgtaaaggatcaaggttgcctgcctcttattccaacagagtcaaataccttacgaggcaggtgcggcagccacgagaggaaatagccagcttcagctacagcccagattttgaacccttcaggtgtaggcttctggccggtatttagctttagaagacgtatacctcccatttagagcagcattcccaaactactcgactcgtcgaaggagattcacagaggctaggcatccaaccgtacggggctctcaccctctatggcgtcccgttccagggaactcggaaggcacgtgataacttctcgaatcgcatggccttgcgccggcgatggttcattcaaatttcttccctatcaactttcgatgtttggggattggccaaacatggttgcaacgggtaacggagggttagggctcgaccccggagaaggagcctgagaaacggctactacacttagttaaaaactaattatatagattatattatatatagcctgatcttagaatattactctttatatatagtaaaaacccctaaaaatatatatatatatatatatattttctattagttttactataaataaagatatattctaagatcaggtaatatataatctaatatatatttttttttaatttaaaattatacttatttagaaataagaaaagttagttatataagattattagttaatttatctctataagtataaggagatgtgcgggatgtaaagatagactggctaccctgcagccgcttcccgagagacagaccgggcgccagaactctggcgtgcaattcacattacttatcgcatttcgctgcgttcttcatcgatgccagaaccaagagatccgttgttgaaagtttttctttatttgtaaaaactactcagaagattccaaaataaaacaagaattaagtttcctaggcgggcgcctgatccggggcagactagggatcggacgatgttaaaaattgactcgttcggcaccttacgagaaatcaaagtgcttgggctccagggggaggatggtcgcaaggctgaaacttaaagaaattgacggaagggcaccaccaggggtggagcctgcggcttaatttgactcaagactagggatcggacgatgttaaaaattgactcgttcggcaccttacgagaaatcaaagtgcttgggctccagggggagcatggtcgcaaggctgaaacttaaagaaattgacggaagggcaccaccaggggtggagcctgcggcttaatttgactcaacaacagggatgcatcactctctgcctttcaaagcttccaatgcaagctcgcgcaattctgtcacaatgattcaggcggggcggcaaacacctcgcttgtatgcctcgcagttgacgggggggctgagttcgccgttcaacccgggctcacgccctaggcttcgtcactgacctccacgtccgcctactcctcagggcatcgtttctaccgtgagggcgaggtgaagctcagcaatatcatcttggaactcttctaggtcgtcttcaggaaaagcatagtgcagtacgtctgttaatctcgccaagctgatgacttgcgcttactagggattcctcgttgaagagcaataattgcaatgctctatccccagcacgacggaggttaacaagattacccaggcctttcggccaagggagtactcgctggctccgtcagtgtagcgcgcgtgcggcccagaacaccaacttagaactggtacggacaaggggaatctgactgtctaattaaaacatagcattgcgatggccagaaagtggtgtggacgcaatgtgatttctgcccagtgctctgaatgtcaaagcgaagccattcgaccaagcgcgggtaaacggcgggagtacgttcaaagattcgatgattcactgaattctgcaattcacattacttatcgcatttcgctgcgttcttcatcgatgccagacgttcaaagattcgatgattcactgaattctgcaattcacattacttatcgcatttcgctgcgttcttcatcgatgccataaccaagagatccgttgttgaaagtttttatttatttgtaatgacgtgacgactgtagatatccgatggctcgcgttgctcttcattgtccttgctattggagcatacctggattgtcctggtgatgcgcgaatgagccattcgcagtttcgccgtataattgcttatacttagacatgcatggcttaatctttgagacaagcatatgacgactggcagaatcaaccaggtaactatcgttcgccggggttggccaccagcgcccacgaggggcactggagaattagttatcccgcgcaagggtcgcaggactacaaccaccagtcgaggtggacgaattcgcccgccgggaagcagaagtggcgcctctgaggcaaacaccaggttccgccgagcggcttgcccaccctcctcaagccccgatgtcatcggcaaccccacagaccccgtgcctgctcccgaggcgtcctcccaaagcccaacgtacccaacccttagagccaatccttatcccgaagttacggatctattttgtgattttccgcaaaattcatttgtatgggaaatcaaaaaaatcgactcacggccaccaaaccgcgcgaccgatatacattacttttcgaacgtcacgtccgacagaggcaatgtaggtccagttggccagctatgggagtcacgcggtgcgccgtccttctttggtaactcttacttcggcccgcaagttgtagcggcgctgttggacacgtcggcgccatatctccagcctggcgcaaacacgtctgttagggctcgaccccggagaaggagcctgagaaacggctactacatccaaggaaggcagcaggcgcgcaaattacccaagttagggctcgaccccggagaaggagcctgagaaacggctactacatccaaggaaggcagcaggcgcgcaaattacccactcccgactcggggaggtagtgacaataaatactgatacagggttcttttggatcttgtaattggaatgagtacaatttacgaccaaccaacagcagagcgcatttgtggatagcaagaagctggtactcaggtgaatggattctctccttctgtcttgagaccccgacatcttgtctagtttcttgactttgttgggataaccggggtagaatgaacaaggtagactaataattactatggcgaatcggattttttccgagagacagctctcagccgttgaggtatgttaccacatgctcggctatcacacggacttcaccaacatcccgcactggtccttcttaaacctgaccgcattgtactgggccatcttccgcagctttcattacgcgtaggggtttgacacccgaacactcgcatacgaagacgactccttggtccgtgtttcaagacgggtccttgcgatatagtaagtatgcttccatattagtttaaattccactatatatagaaagacgaaaaatacgataagtggatatggtaagccgtcgtttgatgcctagcgatacgactaccacaagagtgtgccggagtcgttcacgagttttcgcgtgtcacagtctctttgcccttcaacatcagttgagtatagatattggatatcttatctttaaagctgaaggaattatccaagatctaagacctagtctagggtagcctggttatagggtagcctgccagccagctgtatttaccccttggatcacagttgcctactcccggttaccaggctggactagcttagcctttgtacgatcctctgaggtagtaaccaccattccagggaagataacccccatcataaagccggtctcgtcaaagttgtataggtcctctcgcaaccagcaaatcggtttgccggctttgccacttctacttccagaacgacgacaatgagttcagcgtccagcctccacacatgaacttgtatcccaagtggcgccttcccgataatgcaagcgaagaggtgttggaagacctcatcgacaagatgcagaggataatgagaggatgcattggatcgagcaatgtcttttgcgtgatttggtacagcatgcggtctttattgggcgttgtttgtcactttttggaattttcgaccagaaaatggaaaggtactacatagcacacccagacactctcaccatgatcatggcctttcggccaagggagtactcgctggctccgtcagtgtagcgcgcgtgcggcccagaacatctaagggcatcacagacctgttaaagttgagagaacggaccagcttcatcccggaatgggcgtgcagtcgagcttcggagagacgtgtttgcgccaggctgaagatatggcgccgacgtgtccaacagcgccgctacaacttgcgggccgaagtaagagttgccaaagaaggacggcgcaccgcgtgactcccatagctggccaactggacctacattgcctctgtcggacgtgacgttcggggaatgtggctccctcgggagtgttatagcccactgtgtaataccctggggtggactgaggttcgcgctctgcaaggaggctggcgtaatggtcatcaacgacccgtcttgaaacacggaccaaggagtcgtcttcgtatgcgagtgttcgggtgtcatctacattgttctatcaaccagaggctgttcaccttggagacctgctgcggttatgagtacgacctggcgtgagaattattcccaatactgctatcctgagggaaacttcggcggaaaccagctactagaaggttcgattagtctttcgcccccatgcccatctttgacgatcgatttgcacgtcagaaccgctgcgagcctccaccagagtttcctctggcttcaccctatacaggcatagttctaataaaaaacctattagctttctaactagaagctataatatagaagaagaagaaggttatacttctaattcctctctatcttcagaagaagatatttccttagagacttataagacctctagacctaagagttatatatgatgaggcttgataacttctgagcaggataccgaggtcttggggtggcaagtaaacagggaagtaatgtaaatgaaaagcaaaatctaacctacactttacataacctgcacctcacatgacctacactttacataacctgcacctcacataacctgcaccccacacttggaaagttgggggtttaacggcaggggctcgtcgctctccgatgcggaatatcactacttcgcagaggaggccacgacttcattactataggaaatctaaaaaatcaactcacaactaccaaaaccttcgaccgatatatatagcttttataagacccacttttatctaaaagagactcttaagctgatcagttgagcgagaacgatgaagcacaagaatatctcttggcgagtgagtcgacggcggagctcgaggtagtcatgaacaacgacacgagatggaattccacttacctactggagaattagttactgaatggcactcgtgagagcgcgccgaacacagcaccagcggcagggccaccgacgccgcgcccggcaatccaccttccccctctcagttccccagggcatccttccaccacaccaagaccactagggccggtgcggcttggctgcctggggcccccgccgtcgtctccgcgttcagttgcgttgccgcgcaaaacccacatccaggtgccggaatattgaccggcttgcgctagcgctacacaaaaataaatataaataaatatgaagaatattattcctattaaattctatttagatgttaaaattaaataaaagattattttagtacttattttatagtagtattaaaaaaaaataaaaataaggaaattagatttcctattcgagaagttatcatgaatcaccagagagccccgaagggcattggtttttaatctaataaatacatcccttccgaagtcatccctagtaagcgcaagtcatcagcttgcgttgattacgtccctgccctttgtacacaccgcccgtcgctactaccgatatccctagtaagcgcaagtcatcagcttgcgttgattacgtccctgccctttgtacacaccgcccgtcgctactaccgagtgaatggctcagtgaggcgtccggactggcccagagaggagggaaaccaccactcagggccggaaagctctccaaactctagggaacgtgagctgggtttagaccgtcgtgagacaggttagttttaccctactgatgacctcgccgcaatggtaatttagcttagtacgagtaatcagggtgtccaaatgcttatgagcgtaggtctgtatatctcgaggagcaataccagacgtcataagattagatatgatcgtcgcatcttgctcctctagtcggcggtgcgccgggtgcgcagacgggtcctcacttggtggatgatgctgagattcgggatttaatatgctcagactgtgcgcttgcctcgtacacagtctgtggcgtctttagaacccagggctgccttatctcaggtaggatctctggtgggaggcggttttggctgggttaacttcgggcacagaagcagagcggaagctgagtcggccaagccttgtgtcgcagaggggaacaaagggccaatgtttttttcttctcccgctcgacagaaagccgaaagcgtgggaggacagagcggcgagggcataccagattggcaaattgccattgcatcgaacatggcactttctgcaagtatgggatccggcccggctcctagtatgatgcttacgaacccgttgtcctctctccgcatcagcttcctcattataatcgaaacgatgacgaggctgcaggacgaatttgacagcagccatcggcttaaccgaggataagatctttctcacgagtgccattcagtaactaattctccagtgcccctcgtgggcgctggtggccaaccccggcgaacgatagttagttgggtattggccaaacatggttgcaacgggtaacggagggttagggctcgaccccggagaaggagcctgagaaacggcgactacatccaaggaaggcagcaggcgcgcaaattacccaatcccgactcggggaggtagtgacaataaatactgatacactgctctcgccggcgctggatgggttctgtggatggatggccgctggctaaacttaccactgagcaacgggagatcgccccgccaaacttcagcacatgcacctcactgggaatgccaccaaagcatattcacacacaacacacgccacctaacctatactttacaccaaacttcagcacatgcacctcactgggaatgccaccaaagcatattcacacacaacacacgccacctaacctatactctacataacctatactcaacataacctacactttacataacctatactcaacataacctacactttacataacctgcttcgccttcagcactcgcgcccctctctcataggtgcaccgacccacatttaccctcgtgcacgccacggtcggttccctggccacaaagggaagccggtcaatattccggcacctggatgtgggttctgcgcggcaacgcaactgaacgcggagacgacggcgggggccccaggcagagttctcttttcttcttaacggtctatcaaacccaggtgcttgttggaagagagtctaacgtatcaggaagcgagcggctcaccccatcgggaaggacccccgccgcctaccgtttggcaggaaggctttcgtcagcattatgctgattcgtaagcatctcattgatttgttggattatttcgattttatgaaatagaaaggtcgaatcgaatgtcttgatatcccgggttctcataatataatgcattcctgccaccaatagtgtgtcttgaagggtggctgcattatgtataagacggaatgcggacggtggccccgttgccgacccggtgttcccaatcctcggcgaactgtcggagcacctccatgtcggaggccgtagctgtcttgatgctaagatcaccgctcttcagcatcagcacccaggtgctggctgccgccggccggttgcccggctagtggctgcctgctcccgaggcgtcctcccaaagcccaatattaacaggccacaagccggaccccttccagcccgagcgaatattcgtatctgttagaccgatcaatcgagcctttgtaaccctgatgtgcccacatgaaaatgagatgacagtagggttcagacctacgaccaaccaacagcagagcgcatttgtggtagcaagaagctggtactcaggtgaatggattctctccttctgtcttgggaccccgacatcttgtctagtttcttgactgcgctgttgctgtttgatcctatctccacttcaatttgccgttattaccagcctttttaaggtttgtgagtaatttgaagattccgctgtccgtacggtaggtacctgtaaccccaaccttcatttccctcaaaacgatgaataggtcggggcttgagatcaaatatatctgaatccgagctggtccgctagtacactacatggtaaaccagttcttatcaagcggagttttagctgtatataaatccaaaaatacattcccaagactggggtctaacttccactatagttaaagcaggggtcactaaaaacataaccttggccaccagcgcccacgaggggcactggagaattagttactgaatggcactcgtgagagcgcgccgaacacagcacccgcggcagggccaccgacgccgcgcacggcaatccaccttccccctctcagttccccagggcatccttccaccacaccaattggatcccatctgcgaagatataaaggatcaaggttgcctgcctcttattccacccacttcgatcggattttccttgtattatcttcgtgcctttaacctcgtacgtatagccatccagatattcaaaaggtataggcgtctcatcgatattgacgatacagccacgtcggaagctaggttctgaggcaatacaggtgaatgtgcccacctcagccctcggaggcttcacccagtttgtgccaaatcgtacgagtgcttgatcgaagctatcgagagagaagaaccgagaaatatggctatcgaggagggtgtatccgtcgagttggtcggcatcgagccacgggatcatagggatatctatattatttttgattttcagcaaaattcatttgtatgggaaatcaaaaaaatcgactcacggccaccaaaccgcgcgaccgatatacatgacttttatctcaatgaagcgctgcttatttgctgttatgattgtcggatcatatccaagctgttcctcgttcatccataaaaagcttcaaaagaccgcagcatcacgtggtctgccctcgtcggcagtgtagatacccgagtatctaagtcaacggtccgaccgtccgcctactcctcagggcatcgtttctaccctgagggcgaggtatgggtgagacgcttgagcgccatccattttcatggctcatctaggatgccgtattttgccttcaggttgcgtacgagagtaaaccaaggtctaataacctttggatcttcgcatttggccctctgatagcatctaggatgccgtattttgccttcaggttgcgtacgagagtaaaccaaggtctaataacctttggatcttcgcatttagccctctgatagtcatatttccgaacccagcgcgtacgaagctctggttgccgcctggagaaggagatgtgcgggatgtaaagatagactggctaccctgcagccgcttcccgagagacagaccgggcgccagaaatactgatgcccccgactgtccctattaatcattacggcggtcctagaaaccaacaaaatagaaccacacgtcctattttattattccaatactgatgcccccgactgtccctattaatcattacggcggtcctagaaaccaacaaaatagaaccacacgtcctattgtattattccatgctaatacataatcaaccacagcgcacccacaccaccacaaatccaaccacagcgaatgcacgccactgtaaattccaccacagcgtacataatcaaccacagcgcacccacaccaccacaaatccaaccacagcgaatgcacgccactgtaaattccaccacagcctgcatgcaccaacataatcaaccacagcgcacccacaccaccacaaatccaaccacagcgaatgcacgccactgtaaattccaccacagcatgcatgagttagttaagggcctgcttatagtaataaagctgcttttaatattatagatccagtagctatatctacttagtctattgctttattatatagcctacctagtactactataggtacttacagaggatagagactagctagaagaaaagctatatcacgagatggaattccacttacctcatgatctctcgagcgctcgtgaagcagggagacattagggcgttcttggtccatccagaggtggagaagtggctacccgacgagatggaattccacttacctcatgatctctcgagcgctcgtgaagcagggagacattagggcgttcttggtccatctagaggtggagaagtggctacccgaggccgacatgttgaggggggacgactggaggctcttggcagaaatcaagcatatcaaaggtttttattaggaataatatagatttaatattaatctaatatctatttatatatagttatttatactatataatatgatatggtagtgatacgtccgcagacttttgctgacattccgatgcttcaaaggtaggttgaacaggcaagagttgaaagccgtcagacctttgatagaccctcgtgagacaggttagttttaccctactgatgacctcgccgcaatggtaattgagcttagtacgagaggaaccgctcatggagatgacccaatccttcggtagcgcgctgtcttcataccagttggagagatgatattgccccgcaacgatgataaatagcgggattgcctcacctcgggaattaatagattgaattaccgaaacccattctctatcacctggctgagctaaggttggtaaactcttcagtttgggaatttagaagatttcttatatcttctacttcttcctctaaagcctctagattcttattagagtctataggactagaaggaaccttataggaaccctctaagagttgttttcccttagacccagaagtagccattttaacttatcagtattcaattgtcagaggtgaaattcttggatttattgaagactaactactgcgaaagcatttgccaaggatgttgtcttcaataacgcgaacacagtgtacaatttgaggttggaacttcgtccactagcggtgtcacctggcatcgatcatcatgcatccggaaaagagaatgttgcaatcctgactcgcttcctgaaggataaagaggagccgtgccatggtttgtattcacactgaaaatcaaaatcaaggggacttttacccttttgttctactggagatttctgttctccattagccccccttaggacacctgcgttatggtttaacagatgtgccgccccagccaaactccccacctgacaatgtcttcaatccgggactatgtgcaggagagcggacgggcagggcgggacgggcaggcaagccaggcggttctcatcagcccgagagagatgaaagagggcagagggttggggcgggcagagcagaagggggtggacataagcatgctggcgtttacgcaaggatccagttattcaagagctgttttggcaatatggcaactgccgaaacccattttgatggtctcttgactctactaggcctctacatgttagaaggcaggcttgatacgctgatggattttgacgaggagcttacaactcggtatcttgtattgtaagtcttgtcggtggccgtgagtcgatttttttgatttcccatacaaatgaattttgcggaaaatcaaaactggcccgggaactgaccggggcgtgcaagagggtaaatgtgggccggtgtatttctgaagagtacccaggctcatgggagggcgtcccgcgggcgctgagtttaaattctctatatagtttatattatatagatttaatttatatatatatattatattctaaaactatagtttatatttcttttgagctggaattaccgcggctgctggcaccagacttgccctccaattgttcctcgttaagggatttaaattgtactcattcccctcgttgaagagcaataattgcaatgctctatccccagcacgacggagtttaacaagattacccaggcctttcggccaaacctcacatgacctacactttacataacctgcacctcacataacctgcaccccacaggctatctcaccgcctgtagctcagggatcattaccgagtttacaactcccaaacccatgtgaacatacctactgttgcttcggcgggattgccccgggcgccgcgtgtgccccggatcaggcgcccgcctaggaaacttaattcttgttttattttggaatcttctgagtagtttttacaaacggcgccggtgaaataccactactcctattgtttttttacttattcaatgaagcggggctggatttacgtccaacttctggtgcaccgacccacatttaccctcgtgcacgccacggtcggttcccgggccacttttgattttccgcaaaattcatttgtaccccgctaaaattccaaccccagcgcacccaacccactacataatcaaccacagcgcacccacaccaccacaaatccaacccacatctctatagccacagtccagaaagtctcgttccgaaaggtctgctggcgggccccgtagggggccggtctcctgtctcaatagcggggataccgccacctgcgccacaacatctgcgccacctcaagccacatctcaatagccacagattagacttggggccaacctaggatattctcagacgacctaacctatacccaggctaccctatagccagcctaccctagactaagtcttagatcttagataattccttcagctttactacctccccgagtcgggattgggtaatttgcgcgcctgctgccttccttggatgtagtagccgtttctcaggctcctcctccggggtcgagccctaaccctccgttacccgttgcaaccatgtttggccaatacccaaacatcgaaagttgataggggaagacgagaaaataccaaccctgcgggccttgcgctcctggtgacccccgaaatacaccctgtctttgcaaataaaccttgcctttgcattgccggtaatatcagataactccgaggtaactatttaagaggtttaaactatggatagcggcagatccttcccaaaatggaatacatcaggcttcaaatccttcagtatgagtttcacacaaaccagatgtaactaaattctaactaacgctcttaatgccagtatcactgttgagggtaacccgtcccttgaaaatccgcgggaaggaataattctcacgccaggtcgtactcataaccgcagcaggtctccaaggtgaaccgcctctggttgatagaacaatgtagataagggaagtcggcaaaatagatccgtaacttcgggataaggattggctctaaaagcagttgtacagaagagaggttgagaagctaatacggatgtatattacctatattagcaagcttgagtttctctcttcctttcgtacagctttcttctactcctttacagaggaaaatatccaggcaggcttaagacgctaagccgaagcctattcttgtccatctgtacgtgcgggtggtatcaccgctttctggcatggattctgactgagaggcgttcagccattatccagcagatagtttcagccttgcgaccatactccccctggagcccaagcactttgatttctcgtaaggtgccgaacgagtcaatttttaacttatttagaaataagaaaagttaattatataaagttattagttaatttatctctataagtatagtatatatttactactatagaaggtttttattaggaataaattacaatacgcgaaatactacagcacacttctagtaccgtagagtaatcgcctgctaagacgctaagccgaagcctatgcttgtccatctgtacgtttttttcaaagtaaaagtcctgtttccccgctacacccagtgaagggcatagggttccacagagggaaaggcccggccggaccagtacgagggtcggcgatgttgtcgatgagcgacggcaactccatgttgccgtgcaaccacaggagcccgtgcaggtgcaggctaccacggtcgttcgtctccaccgttgattttacataccctgcagcgcccgcgggacgccctcccatgagcctgggtactcttcagaaatacaccggcccacatttcccctcttgcacgccacggtcagttcccgggccagttttgattttccgcaaaattcatttgtatgggaaatcaaaaaaatcagcttctgcaacaggctggacgaatgacgagatcgctcttgcatggcttgacctgatcttcatcccgttgacgaagcctgagactaagagacctaggttacttatccttgatggccacggaagtcatacaaccgatgaattcatgatcaaatgcttccaaaacaatatattccttcttttcttaccttcgcacccactacataatcaaccacagcgcacccacaccaccacaaatccaaccacagcgaatgcacgccactgtaaattccaccacacaaggggaatctgactgtctaattaaaacatagcattgcgatggccagaaagtggtgttgacgcaatgtgatttctgcccagtgctctgagatttaggggccggccgtccctcgcgggctttggccgatccccaacaccacgccctaggggcatgagggttgaaatgacgctcagcgggtcgttgatgaccattacgccagcatccttgcagagcgcgaacctcagtccaccccagggtattacacagtgggctatattcactgaattctgcaattcacattacttatcgcatttcgctgcgttcttcatcgatgccagaaccaagagatccgttgttgaggtcggagaagccaacccctccctgatttcatctccgcttcccagatcccagtcgccaaggcataagacaaggcaaagtcacctcttgtcctcacgccgcaagctttcatttcatgtccgataaaccccactgacgttcccatatcaaatgtccatacgaccaaccaacagcagagcgcatttgtggatagcaagaagctggtactcaggtgaatggattctctccttctgtcttgggaccccgacatcttgtctagtttcttgactccaggtgccggaatattgaccggcttccctttcgccacacggcgcaaagtgcgcctttgaaacggaacttccctatggcgtaaatccgcgacagatcgaccccaagtctgcgcctcctcccgcacatcgatcaaattatattctgtctcatcagaatccacctgatcaaatgcttccaggtattggccatagtctaactcgtgtggttgtggagttatgggctgataagcggcgttcttatttatatagctagctaagatatagataatagtaactctaaaaactctaagaagagcttattaaatatataacttagctattatatagtataaataactatatataaatagatattagattaatattaaatctatattattcctaataaaaaccttccggatggatttgagtaagagcatacggggccggacccgaaagaaggtgaactatgcctgtatagggtgaagccagaggaagcgcgccgaacacagcaccagcggcagggccaccgacgccgcgcacggcaatccaccttccccctctcagttccccaggccatccttccactgtccctaataagccgactccaacaggcttcaagatatgggttctaggccaaagaggctatttcctccgctggctgtggcatataccagattcagtttctaggaccgccgtaatgattaatagggacagtcgggggcatcagtattcaattgtcagaggtgaaattcttggatgtattgaagactaactacttacgatctgctgagggtaagccgtccttcgcctcgatttccccaatacaggcggccctggtggctggctgcgtaggggggttgggagatggattacaaggacgccagagttctggcgcccggtctgtctctcgggaagcggctgcagggtagccagtctcctttatacagcactcatcaatggcggatttattggaaatccatttcgttcagcgcttcggcattgcgaaaatccttcctaaagatggaagtatgtcatacgatgacctcgcaaaagtcacgggcctcctcagtccaccccagggtattacacagtgggctataacactcccgagggagccacattcccaaagcctttatcccccgcggcgaactgatgctggcctggtagagcttacgaaaaaagataggtactaaagacaggaaacattacaccttcgagaagctgtgggattttcaaaagagttagtagccgaggttcaatcaagcctcaatgacttaaaggagagttacaacaggtacaaagagcgaatgtactcacttatttcctcctctctgggccagtccggacgcctcactgagccattcaatcggtagtagcgacgggcggtgtgtacaaagggcagtgacgtaatcaacgcaagctgatgacttgcgcttactagggattcctcgttgaagagcaataattgcaatgctctatccccgggttgaagacattgtcaggtggggagtttggctggggcggcacatctgttaaaccataacgcaggtgtcctaaggggggtttcttttgttcgatcgataatatggtgcgcaagctggaacggcgggtgcagaccattctcgaataagcaatggcaagaaggctctcaatctggaacaaatagaagcaattcctccacacgtcgtcccgccatggtggacgggcccaaggacatttatcgaagaaaatgccgagaaggcacaagcgaggcaccagtacaacactgtaaacgagttaaacgctctgcatatatacacggacggaattgcgtcaattctaggcaggaagtctccaagcttatgaagtaatgaaggccgaagtattgggctggatgcccatgtccccgggttaactttcaaatcggtgtgtggtctaccgctttataatctcaagcgcagcggccgcctcccggagtacctcgtattggggatcggccaaagcccgcgagggacggccggcccctaaatctagtggcggacccgtcgtggcctcctctgcgaagtcgtgatattccgcatcggagagccgcaccgacccacatttaccctcgtgcacgccacggtcggttcccgggccacttttgattttccgcaaaattcatttgtacctaataccgagagatcggcgcgggcctgatacctcgaagagtgttctgatcctatccatcgcacggattgaaggaagaagatgacctcggtcatccggatatgaatatccctagcaattgctccgatccctagtcggcatagtttatggttaagactacgacggtatctgatcgtcttcgatcccctaactttcgttcctgcgccttcccagacgtgctcgtcgccacgaggatgccgtccattcttctagccaacctaattgccacctcggggtcgttgtcgtgccccacaggccgccttcccagacgtgctcgtcgccacgaggatgccgtccattcttctagccaacctaattgccacctcggggtcgttgccgtgccccacaggcagacgccggtgccagggcgatagagtgtacgcgttgatcgtttccatccgctccaccgccgtggccgtgccgcgtgccagagtcaaggtgatccgagaactgagcctgggacttctgctcaacaccaatgctcccttttctttctttagcgatgcattctttcaacaactcgcctggcgacttgaccctcacctatctgaccgagccacgagatctttgaacagctgtatcgcgcctttcgaccttatgacccaaggggctcttacgagggctcttttgaccgcatttttgaatggtctgaggctatacaagcagcttctcttcgatactgggtccctggtacgaatatagctgtagatgagtgtatccagcactttgaaggaagaaaggttcgattagtctttcgcccccatgcccatatttgacgatcgatttgcacgtcagaaccgctgcgagcctccaccagcgtttcctctggcttcaccctatacaggcatagttcaccttctttcgggtccggccccgtatgctcttactcaaatccatttgcgcccgccagtattctggcgggcatgcctgtctgagcgtcatttcaaccctcatgcccctagggcgtggtgttgggggaccgcatgctgtaccaaatcacgcaaaagacattgctcgatccaatgcatcctctcattatcctctcaccctgcccgatgctgcgtggcggcggcgaccctccccgtcaagaccgaagagctgtggggcttctgtgccagcaacagccatgggccgcgacaccatatcacctatagccgatacagttcaacaaagcggtaggcatgatctcatctgatccgttcgactgcttgccggttcagatggtatttaaaacgcttccctttcaacaatttcacgtactttttaaccctcttttcaaagtgcttttcatctttcgatcactctacttgttcgctatcggtctctggccggtatttagctttagaagacgtatacctcccatttagagcagcattcccaaactactcgacacgcttccctttcaacaatttcacgtactttttaaccctcttttcaaagtgcttttcatctttcgatcactctacttgtccgctatcggtctctggccggtatttagctttagaagacgtatacctcccatttagagcagcattcccaaactactcgacctactaccgattgaatggctcagtgaggcgtccggactggcccagagaggagggaaaccaccactcagggccggaaagccctccaaactcggtcatttagaggaagtaaaagtcgtaacaaggtctccgttggtgaaccagcggagggatcattaccgactactaccgattgaatggctcagtgaggcgtccggactggcccagagaggagggaaaccaccactcagggccggaaagcgctccaaactcggtcatttagaggaagtaaaagtcgtaacaaggtctccgttggtgaaccagcggagggatcattaccgaattgttcctcgttaagggatttaaattgtactcattccaattacaagatccaaaagaaccctgtatcagtatttattgtccaggctaccctataaccagcctaccctagactaggtcttagatcttaaataattccttcagctttaaagataagatattcaatatctatactcaactgatcagcttaagagtctcttttagataaactgatgtccagatttccgcgtaatctctttcgaacctctcgcgatcaaggattggatagagtggatagattcgaagccagaaaacttcgagcatagcatctggcggaaaccagctactagaaggttcgattagtctttcgcccccatgcccatatttgacgatcgatttgcacgtcagaaccaattagttactgaatggcactcgtgagagcgcgccgaacacagcaccagcggcagggccaccgacgccgcgcacggcaacccaccttccccctctcagttccccagggcatccttccaccacaccaagaccactagggccggtgcggcttgggcgccccaagtcggcaaaatagatccgtaacttcgggataaggattggctctaagggttgggtacgttgggctttgggaggacgccgcgggagcaggcagccactagccgggcaaccggccggcggcagccagcacctgggtgctgatgcccttagcaggcttcgggttacagggcacctaccctactaaaacaacccacaacagtatacataagcaactggaagtcagccatagcgtgtatcacaccgctaaaattccaaccccagcgcacccaacccactacataatcaaccacagcgcacccacaccaccacaaatccaacctccaagctaagagaagatgtatcggtatagttgtcgatttaggtttcttaaatgcttccttataaagttgttgaagattctggccaataattaatatattaccgtatgtctttaaagctctttcaacctctgaaaattcttcattactgagaaaaaaagaccatataaatgctcttttcaaagtgcttttcatctttcgatcactctacttgtgcgctatcggtctctggccggtatttagctttagaagccgtatacctcccatttagagcagcattcccaaactactcgactcgtcgaaggagtttcacagaggctaggcatccaacctatcgcaattaagcagacaaatcactccaccaactaagaacggccatgcaccaccacccacaaaatcaagaaagagctctcaatctgtcacttcttgtacctcagtcgctccgtattgtcactatggcaatcattcttttattcctggtcaccaggtatgtatacatattggcattgaacaacagaccttttctttgggtgggtacgcggtgcactctgcctgcccaggccagcatcagttcgccccgggggataaaggctttgggaatgtggctccctcgggagcgttatagcccactgtgtaataccctggggtggactgaggttcgcgctctgcaaggatgctggcgtaatggtcatcaacgagttccagaggagggcgaggcaggttggcgattcccgtccacagaacatggccaagctattagacggcctagcgccaggttagagtgctccaggcaggcctttgctcgaatacattagcatggaataataaaataggacgtgtggttctattttgttgggttctaggaccgccgtaatgattaatagggacagtcgggggcatcagtattcaattgtcagaggtgaaattcttggatttccccttaggacacctgcgttatggtttaacagatgtgccgccccagccaaactccccacctgacaatgtcttcaacccgcgtcggcccgcgaaggaccttaaaaccagaagttggacgtaaatccagccccgcttcattgaataagtaaaaaaacaatatccctccgtcagaccctccaacgcgtctaggaaagcactggatggagggctttttgaaacggaacccggaaattaagacattacgaggcaagcgaattgatctccttcgcgttaacggggctacagctgaccgggtcaaggatttcttcgcaataatgccttctatggcgaaagcactgacctcgtccgggctggcatattggtaactcggtattgcctcttctcccagcgtataacagaaagctaccctttccgagatcaatccatgcgcaatggcatgcccaagataacggagaaccttctccaaatggactggctcctggcagccatctggcccaatgggtggctgacacagtatcagctaaagctgcttcccgggccacttttgattttccgcaaaatttattactataggaaatctaaaaaatcaactcacaactaccaaaaccttcgactgatatatatagcttttataagacccacttttatctaaaagagactcttaagctgatcagttgagtaattgagagtctcagatagcgtcggtggtcctttcccatgccgtcagttcccaatgatcccgatggcttgcccgatccatcatcacactgtcccgagccgcgacctggcaaggagcttttagaggtttttactatatataaggggtaatatcctaagatcaggctatatataatataatctatataattagtttttaattaagttctaatctatatctaatcctcaagatgatattgggcagctaggatgataaaaggagggatagcccagccagctgtatttaccccttggatcacagttgcctactcccggttaccaggctggactaagcgtatattaaagttgttgtggttaaaaagctcgtagttgaaccttgggcctggctggccggtccgcctcaccgcgtggactggtccgaactccctgaatggcgatcgtagaccataatgcaacgtaggccactcaacatcgcacatctctagtttggcggctcgggatcaccggtaaatacagctggctgggctatccctccttttatcatcctagctgcccaatatcatcttgagaactggtatcgggaatgcaatctacaaaccatgaaagtgtggcctatcgatcctttagtccttcgacgtgtgaagctagaggtgccagaaaagttaccacagtgataactggcttgtggcggccaagcgttcatagcgacgtcgctttttgatccttcgatgtcggctcttcctatcatacccgcatgatagtgcactaaatagcttgaggaaagtggctagctcgtaaaccttgcacctacggaattcgaacttcaagtgagttaatttaacttggattctggtccactctagatccacgctggccacacgagctaaactcaagtggctatgctcgtaatcaagatgcctgtccgcatacctactgttgcttcggcgggattgccccgggcgcctcgtgtgccccggatcaggcgcccgcctaggaaacttaatgcttgttttattttggaatcttctgagtagtttttacaaataaataaaaactttcaacaacggatctcttggttctggcaagagagccccgaagggcattggtttttaatctaataaatacatcccttccgaagtcgggattttaagcatgtattagctatagaattaccacggttatccaagtagtacgtacccaacccttagagccaatccttatcccgaagttacggatctattttgccgacttcccttatctacattgttctatcagccatatacccctaacaccctgctgctgctgctgccggaatagcactcgtgtgcttattatccccccttcctctccatcctctcgccctaaccctgttgcctgcctagccctggcacatacatcacacgctgcctcacctgcctcgcatggccctggcccggtcagttcccgggccagttttgattttccgcaaaattcatttgtatgggaaatcaaaaaaatcgactcacggccaccaaacggcttctcttcgtcgcattttttacgacgcgctctaacattttaattagaacactgtagcaaatattggcaggcaaactgaatttggccagaagggactttgaccggtccgggaaatggctgccagcagttgcaacgaccgctgcaagtgcatcattcttggatctctgctggtgtggtacatgtggctagtgctgccgttctggcggaaggtacagggtatcatcgggcagcgcggggatggacccagtgcattcctctgggcggatgaggtgatcaagagggcagcaggcgacgcagatggaagcacactgacagctctcaccatgatcatgcaagcacccggccagttacagggcacctaccctactaaaacaacccacaacagtatacataagcctctcaccatgatcatgcaagcacccggccagttacagggcacctaccctactaaaacaacccacaacagtatacataacctctggccatcgcaatgctatgttttaattagacagtcagattccccttgtccgtaccagttctaagttggttgttaaccgttgtcttttgcgtgatttggtacagcatgcggtctttattgggcgtggtttgtcactttttggaattttcgaccagaaaagggaaaggtactacatagcacacccagacactctcaccatgatcatgcaagcacccggccagttacagggcacctacccttcttcaataaatccaagaatttcacctctgacaattgaatactgatgcccccgactgtccctattaatcattacggcgggcctagaaaccaacaaaatagaaccacacgtcctattttattattccatgctaatgtattcgagcaaaggcctgcctggaatctattaaataagcattaaataatcttaaaaaaggatgacttttaagtaaacgcattttttttttatttttattttagtctataaagccaatacattacgacgtaatttttacaaatgtatctcgattttataatcggaaggccaatattgccgtatgccatgaaagtgtggcctatcgatcctttagtccttcgacgtgtgaagctagaggtgccagaaaagttaccacagggataacagatctgcactagaggccgttcaacccgggctcacgccctaggcttcgtcactgacctccacgtccgcctactcctcagcgcatcgtttctaccctggaatgccaccaaagcatattcacacacaacacacgccacctaacctatactttacataacctatactcaacataacctactccgcaaaattcatttgtatgggaaatcaaaaaaatcgactcacggccaccaaaccgcgcgaccgatatacatgacttttttttccgcaaaattcatttgtatgggaaatcaaaaaaatcgactcacggccaccaaaccgcgcgaccgatatacatgacgtttttccgcaaaattcatttgtatgggaaatcaaaaaaatcgactcacggccaccaaaccgcgcgaccgatatacatgacttatggctgtgtctccacagcgtcgacgttgattatgtagatcgcgatttacatgctcgatacgtaacactcatgtaattaatatacttgattcactaaggaaaaaaaatcgtcactctacttaaacatcgctgtgttcggaccagttgccacggcatcgagcaagatgccgagttaagcatgtctggaaatgtcaacctgcaatttgggaatcaaagacaccacacaacccaatggaggctacttcacagtctgaatacctacgaaatagggttatacgtcatcagagcagctcttcatctccaattattgatggaatcaataagattgcaaagggtacacagcgtgttatgcatgaggtggcaatcctacgtgaggaggttgctacaacggcgagtgaagcggcaacagctcaaatttgaaatctggcgcaagcccgagttgtaatttgtagaggatgtttctggcgacgtgcctaatacgtgttttttgtactctgtgttactatcttccaggtctactagctagaaaccaggaacagctttcaataaaccttagaattctaaagtttaatattactgctctcacagatggacaagaataggcttcggcttagcgtcttagcaggcgattactctacggtactagaagtgtgctgtagtatttcgacagatggacaagaataggcttcggcttagcgtcttagcaggcgattactctacggtactagaagtgtgctgtagtattgcgcgtattgtaattttaaacactgaaaatcaaaatcaaggggacttttacccttttgttctactggagatttctgttctccatgagccccccttaggccacctgcgttatggtttaacagatgtgccgccccagccaaactccccacctgacaatgtcttcaacccgggtcggcccgaaatcaaaatcaaggggacttttacccttttgttctactggagatttctgttctccaggagccccccttaggacacctgcgttatggtttaacagatgtgccgccccagccaaactccccacctgacaatgtcttcactaccctgcagccgcttcccgagagacagaccgggcgccagaactctggcgtccttgtaatccatctcccaaaccccctccgcagccagccaccagggccgcctgtattggggaaatcgaggcgaaggacggcttaccctcagcagatcgtaacaacaacaggctccacccctggtggtgcccttccgtcaatttctttaagtttcagccttgcgaccatactccccctggagcccaagccaggctccacccctggtggtgcccttccgtcaatttctttaagtttcagccttgcgaccatactccccctggagcccaatcactttgatttctcgtaaggtgccgaacgagtcaatttttaacatcgtccgatccctagtcggcatagtttatggttaaagacctcttctgcttcgtcgcattcgaagggaggcactgcaggcggggtttgtgttggtggtgccattgtgcacgctcaggatgtaaggtccagagcgtgcaggggatcttgtggcaggggtgtatggggttccacccttgttagaaggacaagggtctccgttcaggaggattctggtgggagaggggttggatattacttcccctactattagggcatatcgttgaaccaaaaaataaccttacgtgctgtaattaagtatataaaacaagaatagcttgcgtcctttggtatacagatttaagtcttttccaatcacttttctgcacgcacttgtgtaatccaattaatccaagcacttcacaacagttactttgtagcgagttaagttgaatattattttctataattaaaaattttgtaagtactaaagcaccaatatctcataaatatttaaatcacgttacattaatagaattaatatgaactataacaccggctgtaatattaatattaatagctttcccttcatttaaattattaaggccatgcgattcgagaagttatcatgaatcaccagagagccccgaagggcattggtttttaatctaataaatacatcccttcaggccatgcgattcgagaagttatcatgaatcaccagagagccccgaagggcattggtttttaatctaataaatacatcacttccgaagtcgggattttaagcatgtattagctctagaattaccacggttatccaagtagtaaggtactatcaaataaataattagtggggttttagctgctactagcggttaaaaccactaactgctagcgatcttagccactggctattagtgatcaataattagtggggttttagctgctactagcggttaaaaccactaactgctagcgatcttagccactggctattagtgattaaattagctgttaaagaccgctattagcggtcccattaagggagtaagtatttataataagatatattaataaaataagtataaaatagagaaaaaaagaagaagctaaatagattttaactagagctagttaaaggagatagtagtagtttcagctaggctagcttaagatagagtttaaatagctggtggtgcccttccgtcaatttctttaagtttcagccttgcgaccatactccccctggagcccaagcactttgatttctcgtaaggtgatatagccagatatataaataacccagctatagctatagcccctaagaggggaagcttattatctaatagtaataactaccttagcggacgggcagggcgggacgggcaggcaagccaggcggttctcatcagcccgagagatatgaaagagggcagagggtgggggcgggcagagcagaagggggtggacataagcatgctggcgtttacgcaaggatccagctgccgacgtcttctgctaggggcaatcccgccgaagcaacagtaggtatgttcacatgggtttgggagttgtaaactcggtaatgatccctccgctgctggatgatgactgccgggtcattttcaaatgcctggtgcaagaattaggcaagacttatttgtacacgccacctttattgggaggaggataggctatatcattttagacctctgtgggttgttgccaattgtacttctaatgggtccgggtcgcgcgtgatctgtcgggagcatgcttttccccataccccatatacgaccttaataaagaaaccacaaccactacattcctcaccggttcattctaatagagaagaaaagattaaaagagaagaaatagctagtaaaatggaagttgataaagaagaagattttaaatctgttgaaattacagtggccttcaaggtgtattgggccttgagaccgctataacgcagcagggaagttcgctataactgtaatccatctcccaaaccccctacgcagccagccaccagggccgcctgtattggggaaatcgaggcgaaggacggcttacccgtggattgccgtgcgcggcgtcggtggccctgccgctggtgctgtgttcggcgcgctctcacgagtgccattcagtaactagtggattgccgtgcgcggcgtcggtggccctgccgctggtgctgtgttcggcgcgctctcacgagtgccattcagtaacgaattctccagtgcccctcgtgggcgctggtggccaaccccggcgaacgatagttacctggttgattctgccagtagtcaatagggaagaaatttgaatgaaccatcgccggcgcaaggccatgcgattcgagaagttatcatgaatcaccagagagccgcgaagggcattggtttttaatctaataaatacatcccttccgaagtcgggattttaagcatgtattagctctagaattagtttccttcctcccatgtgtgtttcgggaaggagcttgaatgtctcggccaggaagttcagtctcttagctataatggagtccatgattttaccagtggccaaccccgtcgaacgatagttacctggttgattctgccagtagtcatatgcttgtctcaaagattaagccatgcatgtctaagtataatgcgagagagaggtcacggaacaacaggcacatgccgccgcaactgtggcatttttgagccttttatccgggctaaggtggatgatacagctggtaagaacctcccaaagcccaacgtacccaacccttagagccaatccttatcccgaagttacggatctattttgccgacttcccttctctacattgttctatcaaccagaggctgttcaccttggagacctgctgcggttatgagtacgacctggcgtgagaattaaccctatacaggcatagttcaccttctttcgggtccggccccgtatgctcttactcaaatccatccgagaacatcaggagcggtcggagatgcgccgaagctctctcctacgttcactttcattacgcgtaggggtttgacacccgaacactcgcatacaccctatacaggcatagttcaccttctttcgggtccggccccgtatgctcttactcaaatccatccgagaacatcaggaccggtcggagatgcgccgaagctctctcctacgttcactttcattacgcgtaggggtttgacacccgaacactcgcatacatctcgcaagaactgggctgcccagatacagcccggcacgcgttattggactacgataattgaatgcataagtgcaacaggtgggcacctcaagcctcttgttatattcaaaggaaagacggttcaacagcagtggtttcctgaatcggtcggagatgcgccgaagctctctcctacgttcactttcattacgcgtaggggtttgacacccgaacactcgcataatcggtcggagatgcgccgaagctctctcctacgttcactttcattacgcgtaggggtttgacacccgaacactcgcatccgaagacgtaattgggcgcggtgtgttttggcacctggaagcttgggctggagagataatttggagctttcttgcggtcctgctgttccttacccttatcatcatcctcacttgacggaagggcaccaccaggggtggagcctgcggcttaatttgactcaacacggggaaactcaccaggtccagacacaacgcttgagcgccatccattttcagggctagtacattcggttggtgagttgttacacagtccttagcggattccgacttcctgggtacgttgggctttgggaggacgcctcgggagcaggcagccactagccgggcaaccggccggcggcagccagcacccggatgcgccgaagctctctcctacgttcactttcattacgcgtaggggtttgacacccgaacactcgcatacgaagacgactatgcgccgaagctctctcctacgttcactttcattacgcgtaggggtttgacacccgaacactcgcatacgaagacgacgccttggtccgtgtttcaagacgggtcgttgatgaccattacgccagcatccttgcagagcgcgaacctcagtccaccccctagacgctgaggaaggaggacgtaataaagagcatagcgcacgtatccgtaggatgccacctggacagggaaaaagagcaccaggtccgttcaacagtaccccatttagagcagcattcccaaactactcgactcgtcgaaggagtttcacagaggctaggcatccaaccgtacggggccctcaccctctatggcgtcccgttccagggaactcgggagtttcctctggcttcaccctatacaggcatagttcaccttctttcgggtccggccccgtatgctcttactcaaatccctccgagaacatcaggatcggtcggagatgcgccgaagctctctcctacgttcactttcattacgcgtaggggtttgacataatatagtgcaaaatatagtgcaaaagaatcttatttttgtgagagagatcagaaaattatactaatttctctcataggtctaccgactaaaaactactctgagccaaactgatccgtctgtgattggctcgtcatacctgtacgtcttggtcacgtgacaaatcagccttttggtcggtctaactaaacagcctagccacaccgactgcttcttcctacctagctgacctttgtgtcgtgattgaatagctcagcactaccctggtctcactcacctcgctaaacgcagcggattcatccagatcctagataatagcttagcttccgacctacgctggcttttggttactagtacgtgggtattagattaatattaaatctgtattattcctaataaaaaccttctatagtagtaaatatatactatacttatagagataaattaatatttaaagaatttaaatactactacttagggataatatataaggttaagatatatatagattataagaatatttaatattttactataatctaataacttaatagaaaataaatctattatacgcaccagacttgccctccaattgttcctcgttaagggatttaaattgtactcattccaattacaagatccaaaagaaccctgtatcagtatttgtgggttgttttagtagggtaggtgccctgtaactggccgggtgcttgcatgatcatggtgagagtgtctgggtgtgctctgtagagagtttttaaggtattaatatctatacccaggctgaaagtataatatttaactttatcttatagtattaaaggtttaggtatagactactaattatattcttactagggatcggacgatgttaaaaattgactcgttcggcaccttacgagaaatcaaagtgcttgggctccagggggagtagggtcgcaaggctgaaacttaaagaaattgacggaagggcaccaccaggggtggagcctgcggcttaatttgactcaacacggcggaaaccatctactagaaggttcgattagtctttcgcccccatgcccatatttgacgatcgatttgcacgtcagaaccgctgcgagccccctgaaatcggtttgtccggagctagggtttaatggccggaagagcccagcacctctgctgggtctggtgcgctctcggcgtcccttgaaaatccgcgggaaggaataattctcacgccaggtcgtactcataaccgcagcaggtctccaaggtgaacccctgaaatcggtttgtccggagctagggtttaatggccggaagagcccagcacctctgctgggtctggtgcgctctcgccgtcccttgaaaatccgcgggaaggaataattctcacgccaggtcgtactcataaccgcagcaggtctccaaggtgaaccattgcttcttgccggccctgagcaagacccgtcaccaactgcgactccgatgccgactttggttccagctctagtcttgtagctagtctaggggacgacggggactattgcccctctctttatctgaaagaggctcttaagctgatcagttgagtatagatattagataccttatctttaaagctgaaggaattattcaagatctaagacctagtctagggtagtctggttatagggtagcctggtataggttaggtcgtctgagaatatcctaggatttttcccggattttctagacccttattcttgagctgccgtcagaggcataagctgcaaagaagctatcgcaaacctgctgccgccacgcccgttggtctgtataaggctgccaatttggctgcctttccaactagatgtgaggcccttgtggatgaagaattccgagagggtgcacaaaggaggagtgttcaagagcgaagggatgagggtcacacagaagcccgcaacaataacgcgagttttgtgttgttctacttcttcctctaaagcctctagattcttattagaatctataggactagaaggaaccttataggaaccctctaaggattgttttcccttagacccagaagtagccattttaacttctataggtctctaagctatagctttagtaaaggcttaatattatcaatactagtgggccatttttggtaagcagaactggcgatgcgggatgaaccgaacgcgaggttaaggtgccagaggagacgctcatcagacaccacaaaaggtgttagtacatccagacagttggacggtggccatggaagtcggaatccgctaacgcacatctccttctccagtatcttaggcgatatagccttcagggtagcttagaagagatgggatggcgggtttacaaaggtcatgtatatcgggtgagtcgatttttttgatttcccatacaaatgaattttgcggaaaatcaaaagtggcccgggaaccgaccgtggcgtgcatataaaaagtagtttattctattatgtatatattatataacagttattgttatataacttattatattacttattaatatattattatataatagttattattatataattctttatagctataccgctatgatatgctatgttacataaagaattataggctgttcgtcagatgttttgggctgccttcagtcatcagaggcgttccgggctgatagctcttgacggccgggtcaatggccagcatattgttgatctatattcagctatgttgcctgatattgttggtccaggggatatctttatgcatgataatgcatatatagcccccgggtccctaatcattcgctttacctcataaaactgagttcaatactgctatcctgagggaaacttctgcggaaaccagctactagaaggttcgattagtctttcgcccccatgcccatatttgacgatcgatttgcacgtcagaacgttgtttaggtcgtgagttcgaatcccaccttgggcataattatgttattctatatcatttcttataaaaatataattatataaaaacttttgtgctataaatcacaagcgtctcacccatacctcgccctcagggtagaaacgatgccctgaggagtaggcggacgtggaggtcagtgacgaagccattgatagcattgcttcagacgacactgtctgtcgtatcgttcgcattggaagacctctccttgccagatgagtccttcatcgatgatcttgttggcatcctctggcctggtaaactcgatgattaccgatgatgccagcggcagggccaccgacgccgcgcacggcaatccaccttccccctctcagttccccagggcatccttccaccacaccccccaacaccacgccctaggggcatgagggttgaaatgacgctcagacaggcatgcccgccagaatactggcgggcgcactgtgcgttcataaataaataaataaataaataaataaataaataaataaataaataaataaataaataaataaataaataaataaataaatacttaattcttgttttattttggaatcttctgagtagtttttacaaataaataaaaactttcaacaacggatctcttgggtctggcatcgatgaagaacgcagcgaaatgcgataagtaatgtgaattgcagaattcagtgaatcatcgaatctttgaacggggcaatcccgccgaagcaacagtaggtatgttcacatgggtttgggagttgtaaactcggtaatgatccctccgctgaatattccggcacctggatgtgggttttgcgcggcaacgcaactgaacgcggagacgacggcgggggccccaggcagagctctcttttcttcttcactttgatttctcgtaaggtgccgaacgagtcaatttttaacatcgtccgatccctagtcggcatagtttatggttaatactaggcgagaagcagaaaccgacatacaccccacatctgtgaaatgattggctgatagggactggatataactcacctttatccctttgggtgcgatgcggtgccagccatgtcacgggctccacctaccccccacttttgctgaagtgacttgaagccccacacagggccgtcgaccacctccaaactgccaactaccggcagccaagtctgtctcgttcccatcgagccatctctcgggcttgaaccgtaatataataaagagagagataaaagagagagagagcccatatactatagtatacttaataaaaggaagagccccctatcattaatgccacgacggttcctagtaggatccgttgaaatttggtgggtgaattttcacgctactaaaaggtccgtgtggcgaaagggaagccggtcaatattccggcacctggatgtgggttttgcgcggcaacgcaactgaacgcggaggcgacggcgggggccccaggcagagttctcttttcttcttaacggtctatcaccctgaaatcggtttgtccggagctaggccgtgtggcgaaagggaagccggtcaatattccggcacctggatgtgggttttgcgcggcaacgcaactgaacgcggagccgacggcgggggccccaggcagagttctcttttcttcttaacggtctatcaccctgaaatcggtttgtccggagctaggcgggagagcccgttgctgttcacgctcatctgcaatggtgtccatgttagtgcataatccagatcaggaaagacttcacgggaagggcctgcacgaccgccaatttagggttactacgaaccacatcttggtccctccgtggcgggacttgattttgcggaaaatcaaaagtggcccgggaaccgaccgtggcgtgcacgagggtaaatgtgggtcggtgcacctatgagcgaggggcgcgagtgctgaaggcgaaagcctaaggcgctgcagcaaaccactcacagcgtctcgggtcaactgtaacaagcgatgtcggctcttcctatcataccgaagcagaattcggtaagcgttggattgttcacccactaatagggaacgtgagcggggtttagaccgtcgtgagacaggttagttttaccctactgatgacctcgccgcaatggtaattgagcttagtacgagacaatcgcggcgaatcaagcattttgtgcaagtgtcttgacattggcgactgggattcccacctcacgatgtctcacaagttcctccctccggcaagcaaacggccgcaagggtaagtagccccctattctcttattaagtgattttgtttctaactcgatgatgactctcagtcctcagagattgcgagactttcggcataaagctgggacctgccggactatgcaattgcgacagggaagcgatccgtcacactaaccggaaaagtatcagctggccgcgcacgacatagaagaagatataaaaaattaaggaaagtggcccacatggtggtatggcccacatggtggtggatcacgttatagttatttatactatataatatttaatatacttatagaaaattataataatattcctttagtacttaataattattataatctaatatattatatatagtactaatagataatatattaatttaaattaatctaaattaaaatagctttttaaattaaataaatatttattttaattagtattattaaatagaaaagaattaaatagaatagaaataatcttttatttaattgtaacatctaaatagaatttaataggaataatattcttcatatttatttatatttatttttttgtagcgctagcgcaagctatgctagcaagcataaaagactaacccttgcagacacatagtctagggagaatgtaatacgcgcttcccaccctctaaaacaataatttaccgcggctcttaacaacttttttgattttacataccctgcagcgcccgcggatgcccttagatgttctgggccgcacgcgcgctacactgacggagccagcgagtactcccttggccgaaaggcctgggtcatcttgttaaattactagttagaagcaacagtctcaatttatcccttttacctgtgaatctggaagctgttggtggcgacaccaacaatctcatattacagtgggtcgacaaaagttccggtcaatctggtcagacagccacatcgtcagtccaatacatgatttttgaagccgaagggcaccaccaggggtggagcctgcggcttaatttgactcaacacggggaaactcaccaggtccagacacaatgagggttgacagattgagagctctttctagtggagctgaagctggcgtaacggatggcagtagcgtgtttggaagcgctgttggggtgggagaaggcctaagatgcgcatatcgcaaagggcatgcctttgagctcattgtgtggccctgagtatgacaccttgagcatgtaggcttagctgctatccgcatctgtgacacttgctcgatagcctgttaaccgcagcgggtttgggttgggttctgagttcggggggcaagtgcaggtatcagaacatttgctgtgcgatggtactgtcggcactatccacagatcgagcaatgtcttttgcgtgatttggtacagcatgcggtctttattgggcgtggtttgtcactttttggaattttcgttatatagtataaataactatatataaataggtattaagttaatattaaatctgtattattcctaataaaaaccttctatagtagtaaatatatactatacttatagaagcgaattattgtcctttcaggttgtggattaaaagctccgggtcaggggcctatattatcgaacctggccagaccaccgatcacaaccatcccttcgctccaaaggaaggctatatcgcctaagatactggagaaggagatgtgcgggatgtaaagatagactggctaccctgcagccgcttcccgcagaataaggtggatgctagtgttctacagacagccgacctatggtgcactagcttgctttttgcgtcaagtttcgtcgcgcgctctttccccagttaactctgacaattgaatactgatgcccccgactgtccctattaatcattacggcggtcctagaaaccaacaaaatagaaccacctctgacaattgaatactgatgcccccgactgtccctattaatcattacggcggtcctagaaaccaacaaaatagaaccccacgtcctattttattattccatgctaatgtattcgagcaaaggcctgcctggagcactctaattttttcaaagtaaaacctcacatgacctacactttacataacctgcacctcacataacctgcaccccacaggctatctcaccgcctgtagctcacgcgcttgagtattcgtagctcacccaaccttgcgcccggaagcccgatgagagtcgatacgcctcctcctctgcctcctgggtcttcaccctcaacaagaggtacaccgcctccgccgtcaactcctctagcaactcggtatccttctgtatctaccccaggctcagcgcacagcttcaaccatggcggtgtccgctgcacgtggcgatctcccgttgctcagtggtaagtttagccagcggcagtttattttagtttaatctaaaattatacttatttagaaataagaaaagttagttatataaagttattagttaatttatctttataagtataatatatatttactattacctttagtccttcgacgtgtgaagctagaggtgccagaaaagttaccacagggataactggcttgtggcggccaagcgttcatttaaaccataacgcaggtgtcctaaggggggctcatggagaacagaaatctccagtagaacaaaagggtaaaagtccccaatatctatactcaactgatcagcttaagagcctctttcagataaaagtgggttttataaaagctatatatatcagtcgaaggttttggtccgatatacatgacttttgtaaacccgccatcccatctcttctaagctaccctgaaggctatatcgcctaagatactggcgaaggagatgtgcgggatgtaaagatagactggctaccctgcagccgcttcccgagagacagaccgggcgccagaactcaacaggtctgtgatgcccttagatgttctgggccgcacgcgcgctacactgacggagccagcgagtactcccttggccgcaaggcctgggtaatcttgttaaactccgtcgtgctggggatagagcattgctgcgagctctattagcatcgtaacattccgaaatagaaacccctagtgaggggagttctacctccctcaatatataacatattaaaacagatactgaagaaaataaacacctgtcctcgccctcattctatcactttatactctgctaggcaacagaggaggaatacccgccgaacttaagcatatcaataagcggaggaaaagaaaccaacagggattgccctagtaacggcgagtgaagcggcaacagctttgggataagattctggcatatttgattgatttgtttggctgtttgtttgattgcatttgatttgtgggcagcgctggttggcaggcgattactctacggtactagaagtgtgctgtagtatttcgcgtattgtaattttaaaacgagcggggtcaaatcctgtgcagacgacttagctgtgcgaaacggtcctgtaagcagtagagtagccttgttgttacgatctgctgagggtaagccgaaggctaagctagtccagcctggtaaccgggagtaggcaactgtgatccaaggggtaaatacagctggctgggctatccctccttttatatgttcaaccatgaccacaacaacaatgttattgcaactctttatgcggtgatatatggatagtctaggatgaaatgatgcattcgattcaaatgcgaaaaacccacccgttgggcgacggtatcgcaagctagatatacaggcgttctatctcttctttatccagggcgcttttagaggtgcaggccttattccatttgacccaaaaagcgtcttgtcacggctagatataaggccgcggacgccatcacctgttgaagaggctactgagctaccacaactgtgggttccaaagaccccctgtgaaactccttcgacgagtcgagtagtttgggaatgctgctctaaatgggaggtatacgtcttctaaagctaaataccggccggcgccgaagcacccacctattctacacctcctatgtcttttcacaatgtcaaactagagtcaagctcaacagggtcttctttccccgctgataggaaatctaaaaaattaacttataactactaaaacctttaactaatatatatagcttttataagatctacttttatataaaagaggtgttgaatttgagagattatagccactataagttagtgggttcagattgctgttagcgatcacaaccactagcctctatctaataaactttctaataattctattctatttaattctcttctatttaataatactaattaaaatagatatttatttaattctaataaactttctaataattctattctatttaattctcttctatttaataatactaattaaaatagatatttatttattgacgggacgccatagagggtgagagccccgtacggttggatgcctagcctctgtgaaactccttcgacgagtcgagtagtttagagtttattttagtttaatctaaaattatacttatttgggaataagaaaagttagttatataaggttattagttaattcctagacggcttcggcttcgctggcgggtgattcatagtgggcgtcgaccctcacgaaagcggccgcgtgcggtacgtcggactgaggatgcctggtctggggagagctctgctctcgccggcgctggatgggttctgtggatggatggccgctggctaacatggattctgacttagaggcgttcagccattatccagcagatggtagcttcgcggcactgcccggtcggacagccgcaagtaggtcggcggcatcgctacctgcccattctgccccgcgctcctcagctcccgaaccataccgaccgcggtcttgcttgcctctgcggcctcttttgcggcaatctttgcatctctaccggagctagggtttaatggccggaagagcccagcacctctgctgggtctggtgcgctctcgacgtcccttgaaaatccccgggaaggaataattcccaagagatccgttgttgaaagtttttatttatttgtaaaaactactcagaagattccaaaataaaacaagaattaagttcgtccaactgtctggatgtactaacaccttttgtggtgtctgatgagcgtctactctggcaccttaacctcgcgttcgggtcatcccgcatcgccagttctgcttaccaaaaatggcccactagtattgatacattcgaatgctcacgttcaattaagcgttccatctgcagaccatgagaacgcaggggtggggtagcgagggaggtaatggacgactttgggaggtgatgacaggcatggcctcagagacaggtgaggtgcttgggcagtccgacttacccagcactttcggcgacaggtactctcaacctgctgtcggggtacggcgtactaccgtcaaccttaaactcaagaacatgctcttggacattggtgtcgacgtccgggaacctcagagacaggtgaggtgcttgggcagtccgacttacccagcactttcggcgacaggtactctcaacctgctgtcggagtacggcgtactaccgtcaaccttaaactcaagaacatgctcttggacattggtgtcgacgtccgggaaggctgggagcaagatatgatatatggcaggaggcagccgttttactaggttaataaccacagcctgcgtcgggttaatataagtctcttcatctcgcttcctctgacggcaactccatgttgccgtgcaaccacaggagcccgtgcaggtgcaggctaccacggtcgttcgtctccaccgttgcgtagtaatggctgaccttgccaaagaccgattcttggcctgcacgaacatacttttcgaagaacagggaaacctctctgtggaagaagatggcagaactgaccgggtccatggtactgagggcgatcttgtcgtatcttccccgaagatcggtgcatgcacgctgtggtggaatttacagtggcgtgcattcgctgtggttggatttgtggtggtgtgggtgcgctgtggggcccggccggaccagtacacgcggtgaggcggaccggccagccaggcccaaggttcaactacgagctttttaaccacaacaccaccccagggtattacacagtgggctataacactcccgagggagccacattcccaaagcctttatcccccggggcgaactgggctggccgtggtgttatcctgctcatggtcagcatcggcagaaacatgcctgataacgacctcgccatgggaatgacccttgaagaggcgtctctccacctcaacaatgaagtgtgctccagtgccgggggctcagcggctctctgtgagctcacacagggctgtgtgtgtggaggagggtcgccattagactccgcccctggtgttcggaagcgatctccctcaagctccgctatccgctgttccaggagctcgatttgcctaggacgaggcgaaggacggcttaccctcagcagatcgtaacaacaaggctactctactgcttacaggaccgtttcgcacagctcagtcgtctgcaaaggatttgaccccgctcgttttaaaattacccaccgtcctccaggcccgtgctggttgcgtaagtttactcctagctcaaaccgtattcataaattacgctaaaacatccttggaaatatagactggtgctcgtggtatctgtgtcaatggagaataaaataaataaaaacttaattaattaaataagagctatctctatatagattatcttaatatagtatataatatactaaaactccttccccctctcagttccccagggcatccttccaccacaccaagaccactagggccggtgcggcttgggcgccccaagcggagtgctcagcgcacagcttcaaccatggcggtgtccgctgcacgtggcgatctcccgttgctcagtggtaagtttagaaaagggatagctttttcaacctctaacccttatattcatagtcaaaatggacttatagaaagatctattagactaatcctagaaaggttaagagcctctatattatgggctaatattcctatatatctctggtgttttattataaaagctatagtaaagctagttaatttaactcaactcaagcttctctgcctcctcccaccggccttgattccaatatgttgatgcaagattggccatactcgtcagtgtagagcaactcaagcttctctgcctcctcccaccggccttgattccaatatgttgatgcaagattggccatactcgtcagtgtatcgggatggattctgacttagaggcgttcagccattatccagcagatggtagcttcgcggcactgcccggtcggacagccgcaaaatggattctgacttagaggcgttcagccattatccagcagatggtagcttcgcggcactgcccggtcggacagccgcaacaaccaattatctgaatgagcgagtctgtgtggagggagtgctaagggcttcttggaattcggcatttggagtcccaacaattcttccatcttctagtaggatgcgatagttggcgtttccctcgtagcctaataagatgcacggccttgttcgtggctcggtcagcttcttcctttgctttggtgggatcagatattcccctttcgaccctatcacccttagtcgggataagtcaggcttctcgccgtaccatgcctgccgaggcgtcctcccaaagcccaacgtacccaacccttagagccaatccttatcccgaagttacggatctattttgccgccttcccttatctacattgttctatcaaccagaggctgttcaccttggagacctgctgcggttatgagtacgacctggcgcagatgtaactaaattctaactaacgctcttaatgccagtatcactgttgagggtaaccgacatcgccaggcaaccagggcggctttcgcgttcttagcaaattttcgaccagaaaatggaaaggtactacatagcacacccagacactctcaccatgatcatgcaagcacccggccagttacagtaaagtgtcttggagggcacctgaggtctgaatgatggatgggaggctacaagcccagttaacataagatggatagctaaactcatatccgtgcaggacttacatatccatttccccttgaagatagatactaaattcaggggtgtccttccggtcttccagattcctccccaatacatctgcgaaattgaaggctgattgtgatcctgcttgttaacaagctctttattatacttctcatgagcgtgaccgaatttttagcaaacaagcaatctggatctattttttcagtaacgccaaccagtgatagtgcatgagagatgaccatagtatagttcaatttcgatgcggaacactccaccggagcccagcgcatgtcaccagtgttttgactttgaccgatagattcagttaatcctgtcaaggtctttaggcactcaatcaggggaaacccatcaagatgatggaacttggctgttggaggaaatgccgcgaagaagaaaggtaccgaatttttagcaaacaagcaatctggatctattttttcagtaacgccaaccagtgatagtgcatgagagatgaccagagtatagttcaatttcgatgcggaacactcggttgattatgtagtgggttgggtgcgctggggttggaattttagcggggtgatacacgctatggctgacttccagttggttattagtatataactcagctaaagagataataaaggaatactataccctgtagtattcttcttaaagaaactatatagtatagaacttaattaccctatctataataaagaatttatagctattatataccacttttatctaaaagagactcttaagctgatcagttgagtatagatattgaatatcttatctttaaagctgaaggaactattcacaaatcaaatgcaatcaaacaaacagccaaacaaatcaatcaaatatgccagaatcttatcccaaatcaaacaaatgggaaacaccggatttgaaatgacatttgatatatttgatatagggtaagaggttgagcgggtaagtaaatccgtcgccgtcattggagctggatctagcggcattcagatcgtgccaaacatacagccgatggtgaagcgtctagaccattacgttcgtggtaagacctggattgcaacgcccatggcagatcaggagctcaagaaacgcggcgtcgaagggagcaactttgcgttttctccagatgaaatcaaggacttatggaggagttcaagcgaacatttgaaaaagggaacatcttcacatccggcatttctgtcaagtatggaaacaatgtgctggttgacagcacggggaagcctgaggttgcatttcgcatgccgtttggccttatcccgaagttacggatctattttgccgacttcccttatctacattgttctatcaaccagaggctgttcaccttgcagacctgctgcggttatgagtacgtccgcaacccactcaccgtagcgagcctacgggcgatgaacccgcgtagtctaaaggcacacgtagatcgtgctatagagcaaagcggcaacgagcacattgagaggatcaagactgcgtccactaaccagctgaagagcggtgatcttagcatcaagacagctacggcctccgacatggaggtgctactctggcaccttaacctcgcgttcggttcatcccgcatcgccagttctgcttaccaaaaatggcccactagtattgctagtatagaacttaattactctatctataataaagaatttatagctattatatatatatttaaagaatttaaatactactacttagggataatatataagcgtcggtggccctgccgctggtgctgtgttcggcgcgctctcacgagtgccattcagtaactaattctccagtgccccgcgtgggcgctggtggccaaccccggcgaacgatagttacctggttgattctgccagtagtcatatgcttgtctcaaagaaatccaaccacagcacatgcacatcgccgggaaccaaacttcagcacatgcacctcactgggaatgccaccaaagcatactcacacacaacacacgccacctaacctatactttacataacctatactcaacataacctacactttacataacctatacggcgaggcgggatgaaccgaacgcgaggttaaggtgccagagtagacgctcatcagacaccacaaaaggtgttagtacatccagataccgaattctgcttcggtatgataggaagagccgacatcgaaggatcaaaaagcgacgtcgctatgaacgcttggccgccggagtcgcagttggtgacgggtcttgctcagggccggcaagaagcaatgaatggcggtgataaagggagcctaggcaccgaaggagccggatcgctgagatgcttattcaaaagggagctgatgtcaacacccccagcaatgctctccaggctgcttcagcaggagggcatctggagattgctgagatgcttattcaaaagggagctgatattaacgcccaatgtggcagatttggtttgagttcgccgggtatagggtagctggttgtggtttctgcctacccggtaccccaacttcaaaccggcctcccgccttccacgcggatcggagggaagtgagaaggccagtatttcaaagagctcgcgaagctgattattctgaccaatagtaccttactacttggataaccgtggtaattctagagctaatacatgcttaaaatcccgacttcggaagggatgtagttattagattaaaaaccaatgcccttcggggctctctggtgattcatgataacttctcgaatcgcatggccttgcgccgtccctccgtcagaccctccaacgcgtctaggaaagcactggatggagggctttttgaaacggaacccggaaattaagacgttacgaggcaagcgaattgatctccttcgcgtcaacggggctacagctgaccgggtcaaggatttcttcgcaataatgaaccatccagctatcaaacgcatctctccaagagacatccagctttgaaagaaccctttttgcatctaaaggaacaagtccagctcctctaaaacccccctggatattttcctgggttatagaggtattaaactctagtttgacattgtgaaaagacataggaggtgtagaataggtgggagcttcggcgccggtgaaataccactactccgattgtttttttacttattcaatgaagcggggctggatttacgtccaacttctggttttaaggtccttcgcgggccgacccaggaacgaaagttaggggatcgaagacgatcagataccgtcgtagtcttaaccataaactatgccgactagggatcgggcttgttaggcggaattgtagctgatcattgatcatatctgacacatgaaggatatcgtctgatgaaggagcgcatatttcgcttccaaactcggtcatttagaggaagtaaaagtcgtaacaaggtctccgttggtgaaccagcggagggatcattaccgaggttacaactcccaaacccatgtgaacatacctactgttgcttcggcgggattgccccgggcgcctcgtgtgccccggatcctgggcagcccagttcttgcgagatgacccaagaactaggctattatctccaattccttccataatgccggcttcatcccatattccaacgatgacgaggagggatcttctggatatcaggaatgcgcttgagcgcaaagaactcctttactcgatctgtaaaacaggcgtatttatgtctcccgtgtggttcctctgccgtaggcttgctttttgaccgtattgagagaggagatcatgagaaatctgctcccgcccgcctgctaagacgctaagccgaagcctattcttgtccatctgtacgtgcgggtggtatcaccgctttctggcatggattctgaattgactttattgtacgaggaatagatggaagtggcccgctcgcttgtgtggcccgctcgcttgtggattacgttaccctctttcagcaccttaagaggcgtagttgctcgcaaagggacccttggggagttgacccgacccttcgtacgctccctggatgtgggttttgcgcggcaacgcaactgaacgcggagacgacggcgggggccccaggcagagttctcttttcttgttaacggtctatcttgctatcctcggccccattttgggaagtcccggactctgttcggacttgtttagcgtcggctgcgcaacagaaaaagataaaaaaccagcggcatatctcctcgtctcccccatcctcagcgaagccaaccacgcccaacttagctctcaattaaaacaatatcagtcatgcgtgatgtatgtgccagggctaggcaggcaacagggttagggcgagatgatggagaggaaggggggataataagcacacgaggcgggatgaaccgaacgcgaggttaaggtgccagagtagacgctcatcagacaccacaaaaggtgttagtacatccagacagagcaagatcttctgtcgctaatgagcacgatgtatagttgatgtcagcgaagcgttgcgaaacctagctttagaccatgcctaaaggaataagtccagctcctctaaaacccccctggatattttcctgggttatagaggtattaaatgcttctagaaatgcagggaagactggaaggctccccaagccggtcagcagcttccggtccatccaatagctaaattcatgcccaaagaccggttcttgcagctgcaaaggcgtattcgaatctgcccaaatagcccggacatactccccctggagcccaagcactttgatttctcgtaaggtgccgaacgagtcaatttttaacatcgtccgatccctcgtcggcatagtttatggttaagactacgacggtatctgatcgtcttcgatcccctaactttcgttcctgattaatgaaagattcatagtgggcgtcgaccctcacgaaagcggccgcgtgcggtacgtcgtactgaggatgcctggtctggggagagccctgctctcgccggcgctgtggatggcgctcaagcgtctcacccatacctcgccctcagggtagaaacgatgccctgaggagtaggcggacgtggaggacagtgacgaagggcatgggggcgaaagactaatcgaaccttctagtagctggtttccgccgaagtttccctcaggatagcagtattgaacgcagttttatgaggcctgatctgaggtcaaccttggaaagttgggggtttaacggcaggggctcgtcgctctccgatgcggaatatcactacttcgctcaaatcgccgcactcaaggagtttgtcggggcggatagaatcttgactggatcggactgtaggtttttttcttatgctctagaatcctcgtcataatatgccatattctatcattcttgtttgtgattgaaactgacggaatggttgaaactttagttccatacgttctatatcggggttggggggcctttctcctttctattatatcggggttggggggtatttctcctttccgttatatcggggttgggggcctctctcttttcctctcatcgatgacccgtcacgagagtacaaagataaccccgctcaagctcttgttatccaggaattccgaaagttcatacgaaaggccagactcccttgccctgccagcaaacctgtacttgttgcccctcgtacaaacaaccaccagacttcatatatcttaactccttagtattctaagagcagatacttatagatttccttaataagtactattcttacttcctattatagtttttccaagctaggaataatatctatctggaccttagtatatactatttccttaagtatagctcctaaggctttctatactaagtattctttattattacgggctagttagcaggttaaggtctcgttcgttatcgcaattaagcagacaaatcactccaccaactaagaacggccatgcaccacgggctagttagcaggttaaggtctcgttcgttatcgcaattaagcagacaaatcactccaccaactaagaacggccaggcaccatttggatcctcacaaagagccctctgatagtcatatttacgcgatagaactgttttgaggagtggttgtctctgcacaaagcgggaggcccaattgatgccaacgcgctccgcgtcgcggtcgcgtaacagcaaattcgccatatcttgcacctcacgggaactgaccgtggcgtgcaagagggtaaatgtgggccggtgtatttctgaagagtacccaggctcatgggagggcgtcccgaaaattccaaccccagcgcacccaacccactacataatcaaccacagcgcacccacaccaccacaaatccaaccacagccaatgcacgccactgtaaattccaccacagcgtgcatgcaccaccacaaatccaaccacagcacatgcacatcgccgggatttgatcataaattcatcagttgtatgacttccgtggccatcaaggataagcaacctaggtctcttggtctcgggcttcatcaacgggatgaagatcaggtctagccacgcaagagcgatctcgtcattcgtccagcccgttgcagaagctgtaaaaaaggtaagggatgccaaaatcggactctctgactacctcgaccgctggtaccgctgcaacgggccggtggatgagcagcaaaagtctgcccaaatagcccggattcaacccttccaaagccatacagctatcttgaagagtggtctcagcacatacaagaagtatcaacattgctctatcaaattgggactgatattactgttgatgagtgtattcagggctttacaggtagatctaggcagacctcactgggaatgccaccaaagcatattcacacacaacacacgccacctaacctatactttacataacctatactcaacataagtccgtgcattatgtcctgtcttaccacatataccacatcgtcgaacacgggtcttatcccgtggcttccgaccccgccccaagtgctcttcctgggtaatctgactattaacctcctgttgggctactatatcctgtgattcctgtacatttaaggtcgcacagctaagtcgtctgcaaaggatttgaccccgctcgttttaaaattacaatacgcgaaatactacagcacacttcttattgttatggcgcataaaacttggctgacagtaacgtagaactgccttgttggcatgccaaaggcatagaagcgacactgcagctgggaagcaatgagtaaccgggagtgggcaactgtgatccaaggggtaaatgcagctggctgggctatccctccttttatcatcctagctgcccaatatcatcttgagaactggtatcgggaatgcaatctggtccgtgtttcaagacgggtcgttgatgaccattacgccagcatccttgcagagcgcgaacctcagtccaccccaggggattacacagtgggctataacactcccgagggagccacattcccaaagcctttatcccccggggcgaactgatgctggccgtagcggaatacatatatcaggggacagtgactgattcagacgtttaatcatagattgtacttccttaaggcccagctccttatccatttcaggttcaacaattaagaaaggggaaggtttgccataatagaataaactactttttataaacatatactaaaaaataaataactttaagatatataattgttatttatataaataaaagtataaaaagggattattatggaattttagctgtatattaaagagaaagtaaaataaagatgatataataaggctatgaattagttactgaatggcactcgtgagagcgcgccgaacacagcaccagcggcagggccaccgacgccgcgcacggcaagaattagttactgaatggcactcgtgagagcgcgccgaacacagcaccagcggcagggccaccgacgccgcgcacggcactccaccttccccctctcagttccccagggcatccttccaccacaccaagaccactagggccggtgcggcttgggcgcccgaattagttactgaatggcactcgtgagagcgcgccgaacacagcaccagcggcagggccaccgacgccgcgcacggcagtccaccttccatcggtgttctcccctgctgcctcgtctggggcagcctgatagaacagcttccgatcttccaggtgttccagcaagtatcccatgcctgtcatcacctcccaaagtcgtccattacctccctcgctaccccacccctgcgttctcatggtgcaaatcgatcgtcaaatatgggcatgggggcgaaagactaatcgaaccttctagtagctggtttccgccgaagtttcgctcaggatagcagtattgaactcagttttatgaggtaaagcgaatgattagggacccgggggctatatattgccttcatctggaatagtggttactacctcagagggtcgtacaaaggctaagctagtccagcctggtaaccgggagtaggtaactgtgatccaaggggtaaatacagctggctgggctatccctccttttatcatcctagctgcccaatatcatcttgagctcacgctcagtagaccggccctccctgtatctagccactgtcctcgacttacagcgcttcccaccctctaaaacaataatttcataccacggcagtgattgcatgctttttgacggttatgccgaactttaccattcatcttcaccctgaaacttgaaaaaggagaatggctggcaaaagaagccttatctcttccactatgaatcactggttctattgccacacagagaccgaaaagacctctatctgtaacaagtatcatgccgaaatcactacaaatccgaggagcgggcaagattattcgctggtcgtcaccgacccaactactaatccgcccctcatccgtttaactaggcgagagcggacgggatcgcgtgctttcgaatgggtatggtcgtatgtggcagacagcaacaggtgaggagagtcacagttctctgcctcaagaggcagtgtacacagagagctgcatgaagtcggttgtgattatactccaagaaatgtctcctcttcaggttcagatatgggtattgacgctctcacatcttcgcgcgtgcatagaaccgataaatacaatagcatgtcatgtcctgcctacacaagtacaagagaccaatgcgtactagctccactcatcctcgctattctatatctccacctccctctcgctctcctgtacctctgtgtcattccccccatcccgtgcctcagtgtccggcctgatggcaaaactaattagagtattattctgagtagtataatcaggttattataagctatataatataaattactattaatatataaatattatagagctagtaataatagatatatagataattccaaccacagcgaatgcacgccactgtaaattccaccacagcgtgcatgcaccaccacaaatccaaccacagcacatgcacacctggcgctaggccgtctaatagcttggccatgttctgtggacgggaatcgccaacctgcctcgccctcctctggaactagacaatattcgacaccgatcgagattgggtggcaagggtgggaacggaacttccgctattggccgacgtgtatgtaacgtttgaaagtttttatttatttgtaaaaactactcagaagattccaaaataaaacaagaattaagtttcctaggcgggcgccggatccggggcacacgaggcgcccggggcaatcccgccgaagcaacagtaggtatgttcacatgggtttgggagttgtaaacacagcaccagcggcagggccaccgacgccgcgcacggcaatccaccttccccctctcagttccccagggcatccttcctagctcccttagcagagctcttacgatgtaggctgtatgagaaggggcattatcatgcataaagatatcccctggaccaacaatatcaggcaaccaacaaaatagaaccacacgtcctattttattattccatgctaatgtattcgagcaaaggcctgcctggagcactctacttttttcaaagtaaaagtcctgtttccccgctacacccagtgaagggcatagggttccacagagggaaaggcccggccgccatagctatccgggcggcaaaaccgacagtgagccagctttctgttatacgctgggagaagaggcaataccgagttaccaatatgccagcccggacgaggtcagtgctttcgccaggtatacgtcttctaaagctaaataccggccagagaccgatagcgcacaagtagagtgatcgaaagatgaaaagcactctgaaacgtaacaacaaggctactctactgcttacaggaccgtttcgcacagctaagtcgtctgcaaaggatttgaccccgctcggtttaaaattacaatacgcgaaatactacagcacacttctagtaccgtagagtaatcgcctgctaagacgctaagccgaaggtctttattgggcgtggtttgtcactttttggaattttcgaccagaaaatggaaaggtactacatagcacacccagacacttcgacaacctatacccccagctaccgatcctcgaccgcaactctgtggaacagcaggtgctttacatggagcagaaccctggcgcctactgcctgttgacttcgctctgtgccttcggggctctcaccctctatggcgtcccgttccagggaactcggaaggcacgtcgccagaaacatcctctacaaattacaacccgggcttgcgccagatttcaaatttgagctgttgccgcttcactcgccgttactagggcaatccctgttggtttcttttgaacgcttccctttcaacaatttcacgtactttttaaccctcttttcaaagtgcttttcatctttcgatcactctacttttgcgctatcggtctctggccggtatttagctttagaagacgtatacctcccatttagagcagcattcccaaactactcgcacggaccaaggagtcgtcttcgtatgcgagtgttcgggtgtcaaacccctacgcgtaatgaaagtgaacgtaggagagagccacggaccaaggagtcgtcttcgtatgcgagtgttcgggtgtcaaacccctacgcgtaatgaaagtgaacgtaggagagcgcttcggcgcatctccgaccgatcctgatgttctcggatggatttgagtaagagcatacggggccggacccgaaagaagctctcttaaggtagccaaatgcctcgtcatctaattagtgacgcgcatgaatggattaacgagattcccactgtccctagctactatctagcgtatccgggctaaggtagatgatacagctggtaagaacctgtggcattggggaaggttgcgaggcgtggctacgccggatggtcttgtgagagctatccctacttattttactagtaagccacgtgcagcggacaccgccatggttgaagctgtgcgctgagcactcctcttggggcgcccaagccgcaccggccctaggatcgcgtggcaagtagaatcggtacaacgtgacgcagttcgcgaggcaggcgaggattataggcctgaagacgaggttttctgaggtcaaagaggaaagaggccagagtagacccgggcaggggagaactggggttgttgatggacaggcgcagacgagatagtcgcatattcacaggatacatcgaggaagaagaaaagaaaccaacgtaccaatagaagcagaaacctcaatgccagtttttatcagcgtagccagtcgatctttacatcccgcacatctccttctccagtatcttaggcgatatagccttcagggtagcttagaagagatgggatggctggcgtcggacagtccgaaccagtggcgtttggctcaaagctaaagactcttcggacaatcactacatactgtggtccgtcggacaattcttttgtagtatagtatggtccctcctcggaagttctattcataggctttgctcgtctgaggtcaaccttggaaagttgggggtttaacggcaggggctcgtcgctctccgatgcggaatatcactacttcgcaggttggattgttcacccactaatagggaacgtgagctgggtttagaccgtcgtgagacaggttagttttaccctactgatgacaaggggaatctgactgtctaattaaaacatagcattgcgatggccagaaagtggtgttgacgcaatgtgatttctgcgcagtgctctgaatgtcaaagcgaagccattcgaccaagcgcgggtaaacggcgggagtaactatgactctcttaaggtaacaaggggaatctgactgtctaattaaaacatagcattgcgatggccagaaagtggtgttgacgcaatgtgatttctgcacagtgctctgaatgtcaaagcgaagccattcgaccaagcgcgggtaaacggcgggagtaactatgactctcttaaggtaccacagccagcggaggaaatagcctctttggcctagaacccatatcttgaagcctgttggagtcggcttattagggacagttgttactcgtcgaaggagtttcacagaggctaggcatccaaccgtacggggctctcaccctctatggcgtcccgttccagggacctcggaaggcacgtcgccagaaacatcctctacaaattacaactcgggcttgcgccagatttcaaatttgagctgttgctctaagacctagtctagggtaggctggttatagggtagcctggtataggttaggtcgtctgagaatatcctaggattttccccggattttctagacccttatctgggctagataagcccgataacctaataatagctctgctggtggcccggacccctgtttaagaaacctaaatcgacaactataccgatacatcttctcttagcttggaaagcagaggagatacggattcaaaaataaaaaaatagcgatattgaaattccaaatcgaagattctttttaaaatcagcccagatcgattcacataacagacttatgcgcgggtaggaagtccgccttcgttatgtgtgtaatccccgctctcattatcccttcaatttctttaccataggccttcttcagtggcccaaaacagcattaccgagtttacaactcccaaacccatgtgaacatacctactgttgcttcggcgggattgccccgggcgcctcgtgttccccggatcaggcgcccgcctaggaaacttaattcttgttttattttggaatcttctgagtagtttttacaaataaataaatgagtacaatttaaatcccttaacgaggaacaattggagggcaagtctggtgccagcagccgcggtaattccagctcaaatagcgtatattaaagttgttgtggttaaaaagctcgtagttgaaccttgggcctggctggccggtccgcctcaccgctgtcttgtccgtgggatccatcctatgttcgttctgtttgtctgtacttctatcgccgggctgcagagcgcttgctgcctactgcaatagttgcttgtcttgggtgcgctgcatggagtgcagatgttctcgtatggaagtacttgaaatgcaaggggcttgagaatggatgaaggcaatatatagcccccgggtccctaatcattcgctttacctcataaaactgagttcaatactgctatcggttgcccggctagtggctgcctgctcccgaggcgtcctcccaaagcccaacgtacccaacccttagagccaatccttatcccggttgcccggctagtggctgcctgctcccgaggcgtcctcccaaagcccaacgtacccaacccttagagccaatccttctcccgaagttacggatctattttgccgacttcccttatctacattgttctatcaaccagaggctgttcaccttggagacgtggcctatgctttgaatgcagggttgatgtttggttctttgtcgctgcttgggcgtagctcgaaataggcgatgtctagagctggttcccaaggtactttttgatgagctgatgaataccctcgcctcgagacgtaaccacattttcaaagtgaaggtgctcatcaacctaagctttgataagcttctttttgtgtagatcaagctatgtttcgatgatgtaggcgacctcccggacgtgggcggaagtatagcggtctgcaccgcggagaaccacggatgatcaacctgcccaagtctggtcatgaacgcttccctttcaacaatttcacgtacttttttctaattttttcaaagtaaaagtcctgtttccccgctacacccagtgaagggcatagggttccacagagggaaaggccctgccggaccagtacacgcggtgaggcggaccggccagccaggcccaaggttcaactacgagctttttaaccacaacaacttctttcgccttgttgtagtttcacggctgtagcaccattgacgttgtgacgtcccctgatgggtctttcgccttgttgtagtttcacagctgtagcaccatcactggtgtgacgtctttcaatgggtctttcgtttgattctggtttcacgatgtctccttgtcggagttttccctccaccctgttgcttccttggctgctttgtcggctgcttcattgccccgtatcccctggtgcgacgggatccatctaatttcaacccggacgtgtcgctgatgaagatcgtcgatcagtcgtgtgattttatggaggaggtatgctcctgactttcccaattatctgaatgagcggttcctctcgtactaagctcaattaccattgcggcgaggtcatcagtagggtaaaactaaactttcgtgagggtcgacgcccactatgaatcacccgccagcgaagccgaagccgtctagcctgtccaagtgaccactcagtgttcgtgagggtcgacgcccactatgaatcacccgccagcgaagccgaagccgtctagcctgtccaagtgaccactcagtttttcgtgagggtcgacgcccactatgaatcacccgccagcgaagccgaagccgtctagcctgtccaagtgaccactcagcgctgtttcactgactttataactattttttttcaataacctcgtagctcgaactatttattttaaatattcaactatttttttttaatttctatatatatattagacattctagtgttccttaagttatacatagctttaactttgttaactataacgcagaaggtttttattagaaataatatagatttaatattaatctaatacctatttatatatagttatttatactatataataagaaattaatatattaattatatttattttattattatagttattacttatagtagttattaataataaatatttataagaagataattataattaagataaaatataattaattaattaaaataagcttagaaaagtagttattattaataaataataaagtttctccctttagggattatagttatagctaggttatatatatctagctatataaatagcttctattattagagtttttaagatattaatatctatattcagactaaaaatttatttatttaatctttattctatagaagatctagatatagattactaattatatatataaaaaaaaccctatataataaataaattatatattatatctaatcttagaataatcttacttatagttaaaaaaaaataaaaaaataaaaataattataatatttatatttttctatagtttctagctctatagaatttatatatattctaaatattataaatagtattagagtttattatatttcttaattagatttatagtttattttaatataattctaactattttattcttttctttttttttatttaaaaaaatagttattaatatatattataaagtcatcagcttgcgttgattacgtccctgccctttgtacacaccgcccgtcgctactaccgattgaatggctcagtgcggcgtccggactggcccagagaggagggaaaccaccactcagggccggaaagctctccaaactcggtcatttagaggaattaatggccggaagagcccagcacctctgctgggtctggtgcgctctcgacgtcccttgaaaatccgcgggaaggaataattaatggccggaagagcccagcacctctgctgggtctggtgcgctctcgacgtcccttgaaaatccgcgggaaggaatacttctcacgccaggtcgtactcataaccgcagcaggtctccaaggtgaacagcctctggttgatagaacaatgtagataagaacagccccttgccgccgtacttcctgtacatcgccctgaagcagctgatcctttggcctcaagaaggtccagataggccgcttccccgctctcattatcccttcaatttctttaccataggccttcttcagtggcccaaaacagccaacatcaagtggctgaagaatatgagacgaatgagagggcatgcaaagcgtgattatctgatgctccttgcagaatagctcgaattctgttgagtggtggctttcgtgtccatccatgattagaagacgcccggcactagacgtcgagacacacctcctgccgataaaacaccagatatggaagcacaatctcgaggcactcacaaggctcggtccggccaaatctaaaccaatgaaagcaaggcaaaaattcagcccacgtgatgccatacaacgagtacttgatgaactgtaacaagctggtccgatccgctgtgggaaatctcttcaactgtaccgtatcttgcagattcccactgagtggtcccttggacaggctagacggcttcggcttcgctttagaattagtatatagtaactttataattagctattacttttctcttaaagattctatagtaataactaactaatctactataatactaaatactattaaattaactttatttaatttaatccattctcaaactttaaatatgtaagaagctcttgttgcttaattgaacgtgagcattcgaatgtatcaatactagttggccatttttggtaagcagaactggcgatgcgggatgaaccgaacgcgaggttaaggtgccagagtagacgctcatcagggtaaatgtgggtcggtgcacctatgagagaggggcgcgagtgctgaaggcgaaagcctaaggcgctgcagcaaaccacgcacagcgtctcgggtcaactgtaacaagctggtccgatccgctgtgggaaatctcttcaactgtaccgtatcttgcagattagcatggaataataaaataggacgtgtggttctattttgttggtttctaggaccgccgtaatgattaatagggacaggcgggggcatcagtattcaattgtcagaggtgaaattcttggatttattgaagactaactactgcgaaagcatttgccaatggaggagcgtgacgacgaattcctcgacgagcgtgatgaggacttcttggaggagcgtgacgacgaattcctcgacgaacgtgacgacgaattcctcgacgaacgtgacgacgaattcctcgacgaacgtgacgcgatcctaagccatagggaagttccgtttcaaaggcgcactttgcgccgtgtggcgaaagggaagccggtcaatattccggcagcgttcacgaccagacttgggcaggttgatcatccgtggttctccgcggtgcactctgcctgcccaggccagcatcagttcgccccgctgaattctgcaattcacattacttatcgcatttcgctgcgttcttcatcgatgccagaaccaagagatccgttgttgaaagatcgaaagatgaaaagcactttgaaaagagggttaaaaagtacgtgaaattgttgaaagggaagcgttcatgaccagacgtgggcaggttgatcatccgtggttctccgcggtgcactctgcctgcccaggccagcatcagttcgccccgggggataaaaggtgccgaacgggtcaatttttaacatcgtccgatccctagtcggcatagtttatggttaagactacgacggtatctgatcgtcttcgatccgcgaagctgattattctgaccaccacttcaaaaaaagtcatgtatatcggtcgcgcggtttggtggccgtgagtcgatgtttttgatttcccatacaaatgaattttgcggaaaatcaaaagtggcccgggaaccgaccgtggcgtgcacgagggtaacccgccccggcggggtatcctcgtgaagctgccggaggacgtcggccgcgtgggcaattcgtctccacatgggcgtgtccagctttgtggcatagttggtgatgtaaaacaccatggccaggcccttagcggtcctcgtgtccgctgtagcgcttgcattagcggacctcgtgtccgctgtacgagaaccttagcacttagttagtgaacctagtacgctggcttcttagagggactatcggctcaagccgatggaagtttgaggcaataacaggtctgtgatgcccttagatgttccccctctcagttccccagggcatccttccaccacaccaagaccactagggccggtgcggcttgggcgccccaagaggcgtgctcagcgcacagcttcaaccatggcggtgtccgctgcacgtggcgatctcccgttgctcagtggtaagtttagccaccagcgccggcgagagcagagctctccccagaccaggcatcctcagtacgacgtaccgcacgcggccgctttcgtgagggataattagatataactattactaatagtataaattatatataatagtttagtataagaattaatctaactattattaatatatataaactatatgacctacactttacataacctgcacctcacataacctgcaccccacaggctatctcaccgcctgtagctcacgctcagtacaaaggcctgcctggagcactctaattttttcaaagtaaaagtcctgtttccccgctacacccagtgaagggcataggggtccacagagggaaaggcccggccggaccagtacacgcggtgaggcggaccggccagccaggcccaaggttcaactacgagagtataggttatgtaaagtataggttaggtggcgtgtgttgtgtgtgaatatgctttggtggcattcccagtgaggtgcctttctcaccgtggtaagatagtcgtgcatatggacctctgcatgaataaaagtcttggtcttcctgtcgaagatctgtttacggatctccgattcgagcccgtatttagttagttatataagattattagttaatttatctctataagtataatatatatttactactatagaaggtttttattaggaataatatagattttttatttgtaaaaactactcagaagattccaaaataaaacaagaattaagtttcctaggcgggcgcctgatccggggcagacgaaacacccgatattgaatctcgctccgttagtgacatcgcagtccacacattgagtctcgttcaacggccggagggacagaacgcgctgttttggcaatatggcaactgccgaaacccattttgatggtctcttgactctactaggcctctacttgttagaaggcaggcttgatacgctgatggattttgacgaggagcttacaactcggtatcttgtattgtaagtcttgtctcccactgtccctatctactatctagcgaaaccacagccaagggaacgggcttggcagaatcagcggggaaagaagaccctgttgagcttgccgagtttggagagctttccggccctgagtggtggtttccctcctctctgggccagtccggacgcctcactgagccattcaattcatttgtatgggaaatcaaaaaaatcgactcacggccaccaaaccgcgcgaccgatatacatgactttttttgaattggtggtagtatccggctattaacagctacgacgataacttgctaataagagtcagcggcagccgccgcgagcagcctgcagataatacctgcagacccgtatttgaccccgtacgcgatgcagcccgcgttttcgagcccctcgcgatgcaacctcaagagcctgctggaagtcagccatagcgtgtatcaccccgctaaaattccaaccccagcgcacccaacccactacataatcaaccacagcctggaagtcagccatagcgtgtatcaccccgctaaaattccaaccccagcgcacccaacccactacataatcaaccacaccgcacccacaccaccacaaatccaaccacagcgaatgcacgccactgtaaattccaccacagcgtgcatgcaccaccacgagatctatcgcttcatgttcaaacaacccgaactcgatcatggaaatgttagtcaacaaggaggccatgatgaaaaaaaaaagagacaggcggagaatgaagagatcaaggaacaggcaaagttgtttgcagcaaagataccggagtctgtgttcagcacagcggaggttaatacgtttgcgatgctaatcaagaggatgtggttcccaattactctgaaatggtaccttggggtgagacgccaacggatgttgagatgttctaccaagattacagcaccaacagagatgtgcaatccctcgcatctgtagctgggccgcccgcgggacgccctcccatgagcctgggtactcttcagaaatacaccggcccacatttaccctcttgcacgccacgctcagttcccgggccagttttgattttccgcaaaattcatttgtatgggaaatcaaaaaaatcgactcacggccaccaaaataactaaagtagaatataataatatcctaatagttattaataaacttataaagtatagatactttattctatataaagaaataagctctatagaaaatcttatatactagtttctataatatatagttagttactatagattatctaataaaataatattaaatagagaaataatatttatctctaagttttagtaattacttatagtataaatagaaataaaatataagcttttaatagtttattatttataaaataataattaaatagaatatttaaattaaactttagaataatatctataaatatatattaactataaatagaataattagatataactattactaatagtatagattatatataataggtatttcgcgtattgtaattttaaaacgagcggggtcaaatcctttgcagacgacttagctgtgcgaaacggtcctgtaagcaggctcagtgaggcgtccggactggcccagagaggagggaaaccaccactcagggccggaaagctctccaaactcggtcatgtagaggaagtaaaagtcgtaacaaggtctccgttggtgaaccagcggagggatcattaccgagtttacaactcccaaactctctcgcagagaggatggcgatggccgatctcgatcgaacattttcagctaaggaggcagagtacttatccctgccgatgtggatactcgaacaattgaatggaccaattaacgtaaatggtgaataggtttgctttttccatgatgactttttttgaagtggtggtcagaataatcagcttcgcgagctctttgaaatactggccttctcacttccctccgacccgcgtggaaggcgggagaccggtttgaagttggggtaccgggtaggcagaaaccacaaccagctaccctatacccggcgtgggccggtgtatttctgaagagtacccaggctcatgggagggcgtcccgcgggcgctgcagggtatgtaaaatcaaaaaggctccagttaacggctatacgtgagtgattaatatgattggcatctcttgatcattcaggacctatccaaccttggggatgccattgatgcttaagatttgtcttgcgcgggcgatcgcgttgtacctaggtagcgtagggcttccagtctagtatattaataactatctaaaagagtattctatctaataaaataaatatatatatataggaaggtaatatattagatatagaatatattactattaggaagctgctgtagcgggttttagagtagtttttagtcggtagacctatgagagaaattagtataattttctggtctctttcacaaaaataagattcttttgcgctatattttgcactatattaggtccctctagcactaaaactcactgagtaatagcatcacctgcaacccaagcttctctgcctcctcccaccggccttgattcctatatgttaatgcaagattggccatactcgtcagtgtatcaggatggtctgctccaagcttcgtctgaagaatctccatcacctgcacctcaagcttctctgcctcctccggtctctggccggtatttagctttagaagacgtatacctcccatttagagcagcattcccaaactactcgactcgtcgcaggagtttcacagaggctaggcatccaaccgtacggggctctcaccctctatggcgtcccgttccagggaactcggaagtggagctaatgttgtgctatcggttgatatagtgctgctcgtgtcgttaccgtctgatgccttcctcactaaagcccagtgtaaaatcattgaatggaaggatatatgaatggtcgtccatggttgctgcagacacgagtaatgggaagttaccgaatcgtgaagggcatagggttccacagagggaaaggcccggccggaccagtacacgcggtgaggcggaccggccagccaggcccaagaaagagaagaaagagaagaaagagaagaaagagaagaaagagaagaaagagaagaaagagaagaaagagaagaaagagagaaagagaagaaagagaagaaagagaagaaagagaagaaagagaagaaagagaagaaagagaagaaagagaagaaagaagagaataagaagccactaatgttcatagagacgtctcgtcttcgcagccaggcttttgagtctctgcaccgcatcgaccatagccacctggaacgggacgccatagagggtgagagccccgtacggttggatgcctagcctctgtgaaactccttcgacgagtcgtgcgagtttggttgcgaatgtggtcgtggatgtggttgcgagtgtggtcgtaagtgtggtcgtgggtatggttgcgagttcggttgcgaatgtggtcgcgagtgtggtcaggaaaagaaaccaacagggattgccctagtaacggcgagtgaagcggcaacagctcaaatttgaaatctggcgcaagcgcgagttgtaatttgtagaggatgtttctggcgacgtgccttccgagttccctggaacgggacgccatagagggtgagagaggaaaagaaaccaacagggattgccctagtaacggcgagtgaagcggcaacagctcaaatttgaaatctggcgcaagcacgagttgtaatttgtagaggatgtttctggcgacgtgccttccgagttccctggaacgggacgccatagagggtgagagcggccggcccctaaatctagtggcggacccgtcgtggcctcctctgcgaagtagtgatattccgcatcggagagcgacgcgcccctgccgttaaacccccaactttccaaggttgacctcagatcaggtaggaatacccgctgaacttaagcatatcaaagaaccctgtatcagtatttattgtcactacctccccgagtcgggattgggtaatttgcgcgcctgctgccttccttggctgtagtagccgtttctcaggctccttctccggggtcgagccctaaccctccgttacccgttgcaaccatgtttggccaacaaggagtaaggtactatcaaataaacgataacttatataatgagccattcgcagtttcgccgtataattgcttatacttagacaaattaagacgttacgaggcaagcgaattgatcttcttcgtatcaatggggctacggctgaccgggtcaaggatttcttcgcaataatgaaattaagacgttacgaggcaagcgaattgatcttcttcgtatcaatggggctacggctgaccgggtcaaggatttctttgcaataatgaaccatccggctatcaaacacatctctccgagagaccgttggaatatggatgaagccggcattatggaggcatatccacttatcgtatttttcgtctttctatatatagtggaatttaaactaatatggaagcatacttactatatcgccataactgtatctgttgtcattagccgtctcgcgatcaatattatcacgtaccaaaagggcgatatcccacgtaatagctgaggaatctggaagacaggaaggacacctttggtcttgatgcatcgcgatgaaaacgctcctcgaagaggctacagctcaattagctaccaattagcccttgaggagggtcttctacctctctacgatggaactcgccgttttcaacaggataatgcaaagattcatgtgtctaattcatctatgacttggctgaattaacatgggacacatctgctgttgactggagcttagcctttcacttgtatacgcatggttacgggacatatgccgtctacgccgaaatttttaggagcagagattcgtaggtatgtgttacccgtaccggggttaggcatctctatctacctgggatacccttgttgaaggcagacaaaaacgttttgctgccttcgttgtggccttccgtatgttcttaacgaactggggtcagctgtacaacttcctcggagtttgctgccctgtccccgaccaaaagaatggctgggcatgcggccttctttcgaccttttgcacccttgttgaaggcagacaaaaacgttttgctgccttcgttgtggccttccgtatgttcttaacgaactggggtcagccgtacaacttcctcggagtttgctgccctgtccccgaccaaaagaatggctgggcatgcggcctttaatacctctataacccaggaaaatatccaggggggttttagaggagctggacttgttcctttagatgcaaaaaggggtctttcaaagctggatgtacgattattaacaccaacaccgccaggcacccctctggaactgcctacagtttgggaatcaaccagaggctgttcaccttggagacctgctgcggttatgagtacgacctggcgtgagaattattccttcccgcggattttaccagaggctgttcaccttggagacctgctgcggttatgagtacgacctggcgtgagaattattccttcccgcggatttgcaagggacgtcgagagcgcaccagacccagcagaggtgctgggctcttccggccattaaaccctagctccggacaaacctgcctgtatagggtgaagccagaggaaactctggtggaggctcgcagcggttctgacgtgcaaatcgatcgtcaaatattggcaccccgctgattctgccaagcccgttcccttggctgtggtttcgctagatagtagatagggacagtgggaatctcgttaagccattcatgccgggactatgtgcaggagagcggacgggcagggcgggacgggcaggcaagccaggcggttctcatcagcccgagagataggaaagagggcagagggttggggcgggcagagcagaagggggtggacataagcatgctggcgtttacgcaaggatccagcgcataactgtgttagagttcttcattatttttcattcattcttttttttttatttcttttatttattagtatattaatagattataaaaatgttgggtagtaataaaggattattgtgtagattgggtaatttgcgcgcctgctgccttccttggatgtagtagccgtttctcaggctccttctccggggtcgagccctcaccctccgttacccgttgcaaccatgtttggccaatacccaaacatcgaaagttgatagggaagaaatttgaatgaaccgaaatacaccggcccacatttaccctcttgcacgccacggtcagttcccgggccagttttgattttccgcaaaattcatgtgtatgggaaatcaaaaaaatcgactcacggccaccaaaccgcgcgaccgatataggtactacatagcacacccagacactctcaccatgatcatgcaagcacccggccagttacagggcacctaccctactaaaacgaacatcaggatcggtcggagatgcgccgaagctctctcctacgttcactttcattacgcgtaggggtttgacacccgaccactcgcatacgaagacgactccttggtccgtgtttcaagacgggtcgttgatgaccattacgccagcatccttgcagaaagggctgtcttcacctttaccagtccttttggtattacgaaattttatctctcctccgcaagttctgccctcttccatctttccgagggggcggaagtgtaggggccggcaacaggagaccggccccctacggggcccgccagcagacctttcggaacgagactttctggactgtggctatagagatgtgatattccgcatcggagagcgacgagcccctgccgttaaacccccaactttccaaggttgacctcagatcaggtaggaatccccgctgaacttaagcatatcaataagcggaggaaaagaaaccaacagggattgccctagtaacggcgagtgaagcggcatgaggatgagaaccacatctctctcgcacctctcgacgggccctctgtgacgtgccatggctggttgcagaagctccgtcgacctcatcagtacgccgtgccgatttttcaaggatttatcagcgacgatcaccatgacgagcacccagtgtacttcagacggtatgcgtatcagtatttattgtcactacctccccgagtcgggattgggtaatttgcgcgcctgctgccttccttggatgtagtatccgtttctcaggctccttctccggggtcgagccctaaccctccgttacccgttgcaaccatgtttggccaatacccaaaaacacggaccaaggagtcgtcttcgtatgcgagtgttcgggtgtcaaacccctacgcgtaatgaaagtgaacgtaggagaaacacggaccaaggagtcgtcttcgtatgcgagtgttcgggtgtcaaacccctacgcgtaatgaaagtgaacgtaggagcgagcttcggcgcatctccgaccgatcctgatgtcgcgctctgcaaggatgctggcgtaatggtcatcaacgacccgtcttgaaacacggaccaaggagtcgtcttcgtatgcgagcgtgtgaagctagaggtgccagaaaagttaccacagggataactggcttgtggcggccaagcgttcatagcgacgtcgcgttttgatccttcgatgtcggctcttcctatcataccgaagcagaattcggtaagcgttggattgttcacccactaatagcctctgacaattgaatactgatgcccccgactgtccctattaatcattacggcggtcctagaaaccaacaaaatagaaccgaaagttcggccagcgtcgtgatttatctccagtatgaaaagcctgtgccccgctatgtgtcgctcgtcggtgggtaatcaaaagaatggttaggaaaacgagttggcacagaatagacgccgcaaggaccgcaatcgaggcgataagggagcttttttccaatttcccttataaacccggtgttgcaatccctctgaagcccgaagttgatcaccgatatcaacaccacccatgttgtatagcattgcgatggccagaaagtggtgttgacgcaatgtgatttctgcccagtgctctgaatgtcaaagcgaagccatgcgaccaagcgcgggtaaacggcgggagtaactatgactctcttaaggtagccaaatgcctcgtcatctaattagtgacgcgatatcgttaacgtaaaatgcacctgctctcgcattgacaacagatacgattatctgttttagctagtgggatccaatggttgtcagtatacatcggtgatcacttcaataaagaacagggtattggtatttaaagtttgagaatggatgaaggcaatatatagcccccgggtccctaatcattcgctttacctcataaaactgagttccgggattgggtaatttgcgcgcctgctgccttccttggatgtagtagccgtttctcaggctccttctccggggtcgagctctaaaggtattaatacctatacctaggctgaaagtataatatttaactttatcttatagtattaaaggtttagatatagactgctaattatattcttaaaaaacctacactttacataacctgcacctcacatgacctacactttacataacctgcacctcacataacctgcaccccacaggctaaccctattaaatatatatataaagaactactagtagaaatatataaagaactatagtataaggtttataaagataaaaagcttaaactatagtataattagaagtatatagaagattaaataatatatatatataatagctagattaaataatataataagtggaatttacagtggcgtgcattcgctgtggttggatttgtggtggtgtgggtgcgctgtggttgattatgtagtggggtgggtgcgctggggttggaattttagcggggtgatacacgctatggctgacttccagttgcttatgtatactgttgtggttttctctagttctactaagagttttatatcttctagtttctttaagaccttatatatatattccttatatatttctaggttatctaagaagattaaaatattattaagataaataactataaagatattaaaatactcccggagtacttaattaattatatcggtcgcgcggtttggtggccgtgagtcgatttttttgatttcccatacaaatgaattttgcggaaaatcaaaactagcccgggaactgacctgcgcttccgaattgggaaatgggatttttggggggtgaaaatcccagagcttaagaagacctttcgtaccgaaaggcataggctcctaagagatattcgtggtagtaattggcatatgacgtggatttgggacatacccctgtatgtttcatattagaaacgctcaatgggtaggtgggcggagaatgagaagggacgatggcaagcatcgcaggcacgcttcacggcctgcatcattgtggcgcgttctgtccctccggccgttgaacgagactcaatgtgtggactgcgatgtcactaacggagcgagattcaatatcggatagatgtcggaaaaactagctctgattggtcgggtccactgtctggcatccatcaggttccgggtaagtagcaaagacgctcaccagcctagcaggttacccgctcaacctcttaccctatatcaaatatatcaaatgtcatttcaaatccggtgttggcgtagttgtccttgccttgcttcctcagcacgactgttatcgattcccggaagtgccgtgggcaatatccgagattaagactttggttgaagatcgatgtcaggtgaggtgtaatccatgctgctgctagttgcagtactcggttaataatgccatcaggaccaggggccttgtacggggaggcttcgtgtaattctgcaattcacattacttatcgcatttcgctgcgttcttcatcgatgccagaaccaagagatccgttgttgaaagtttttggaagttagaccccagtcttgggaatgtatttttggatttatacacagctaaaactccgcttgataagaactggtttaccatgtagtgtactagcggaccagctcggattcagatatatttgagcggctttttttagctcttcggcgcttgcttagtacctcatttgccgtacgaagatcccggacctcagcacgtaaaagagccacctggtgcatgtggtggcacactacaacgacgacgagtctgccacagcagacgaaagtggcgacgcgttaccacattacagatatggtggcgaggagcccaacatgatgtttatcagggcgaccatcttgggctgggaagtgtttgttcaaatggttgcagtgagttttttctttgtgaatgatagtgcggtattgaagaggaggaaaaacgcgtaacaggaaaaagggcgggtttgccctaggcatcggcaaacttacgcgtttcaacacaaaactcgcgttattgttgcgggctttccttaggctaaatcttaaggtcactgggatagataaaccgtgtaatttgaattgggataatcttaggattatgtgcgtagcaacaaggtgtgacaggaaaagcctagggcgcatgacggaaaacagaaggtggttttattatccatcaactcccaagtgtggtggatcggtctcgagtttgttgggcggaaagtaagttaacaggtcgtcagtcgtatggaagctggctacatccataaccaacatgtgttccttgccatccagaattacagctaattcatttgctatccaattcgtttatttgatagtaccttactacttggataaccgtggtaattctagagctaatacatgcttaaaatcccgacttcgtaagggatgtatttttttttttttttttttttttttttttttttttttttttttttttttttttttttttttttttttttttttttttttatttttttttttttttttttttttttttttttttttttttttttttttttttttttttttttttttttttttttttttttttctttgttgttacgatctgctgagggtaagccgtccttcgcctcgatttccccaatacaggcggccctggtggctggctgcgcagggggtttgggagatggattacaaggacgccagagttctggcgcccggtctgtctctcgggaagcggctgcagggtaggccggtggatgagcagcaaaaggcaattgtggagactgcggcacccccaagcgtaccaccgaaaatatcaaaaggtagtgtgtttaagcagtgggtcaaaaggagcaacgggagatcgccacgtgcagcggacaccgccatggttgaagctgtgcgctgagcactcctcttggggcgcccacgccgcaccggccctagtggtcttggtgtggtggaaggatgccctggggaactgagagggggaaggtggattgccgtgcgacatctgttaaaccataacgcaggtgtcctaaggggggctcatggagaacagaaatctccagtagaacaaaagggtaaaagtggcttaggatcgactaacccacgtccaaccgctgttcacatggaacctttccccacttcggtccttcaagttctcattagccaccgacgccgcgcacggcaatccaccttccccctctcagttccccagggcatccttccaccacaccaagaccactaggccaccgacgccgcgcacggcaatccaccttccccctctcagttccccagggcatccttccaccacaccaagaccactacggccggtgcggcttgggcgccccaagaggagtgctcagcgcacagcttcaaccatggcggtgtccgctgcacgtggcgacgccatcgctttgttataccggttgacgagtggatggttgcgacggatggtgagcaggttatcctcgctcagccccgtcgcatcgccgtcgaccacctccaaactgccaactaccggcagccaagtctgtctcgttcccatcgagccatctctcgggcttgaagctcaggggattcttaattttattaaatactttttattatttattattctattagaattctatttcttttttaataatattatatagggatataataattttcctataatttttaataaattattagtaatagttagtaaatctaaagaaagtttatacttctttaatattttctagtatttcctaattcttaattataataatcttatattattctatttatattttattaggatttagcatttaatgaacttaacctacgatgaatattaatttcgcatcgcacttcatccaccccaagccagccaataatttctatctaagatttagtaataaatactgtggagactgagggttttctcggcagccactagccgggcaaccggccggcggcagccagcacctgggtgctgatgcccttagcaggcttcggccgtccggcggacggttaacaaccaacttagaactggtacggacaaggggaatctgactgtctaattaaaacatagcattgcgatggccacagccactagccgggcaaccggccggcggcagccagcacctgggtgctgatgcccttagcaggcttcggccgtccggcgcacggttaacaaccaacttagaactggtaccagccactagccgggcaaccggccggcggcagccagcacctgggtgctgatgcccttagcaggcttcggccgtccggcgatctctattaagattaaactattcaaactaatatgctttatagatctcatttaggtctacctataggctagctttagagacatctcagctaggcccggccgagatatatacctttaggctagaccagctccttgatgtgggttttcggctcactcagtgggaatctgcaagatacggtacagttgaagagatttcccacagcggatcggaccagcttgttacagttgaccccactcagtgggaatctgcaagatacggtacagttgaagagatttcccacagcggatcggaccagcttgttacagttgacgcgagacgctgtgagtggtttgctgcagcgccttaggctttcgccttcagcactcgcgcccctctctcataggtgcaccgtgacttgcgcttactagggattcctcgttgaagagcaataattgcaatgctctatccccagcacgacggagtttaacaagatttgacttgcgcttactagggattcctcgttgaagagcaataattgcaatgctctatccccagcacgacggagtttaacaaaatttgaagctgtgcgctgagcactcctcttggggcgcccaagccgcaccggccctagtggtcttggtgtggtggaaggatgcactgggacggggttagatttgcccggcccgtggccgctatcgccgtcctcttcaagaacaaaggagcggccttcctcaatccatctctttacgtacggttcaaggatatccctcttgtaggtctgctgtgtctaggatattctcagacaacctaacctatacccaggctaccctataaccagcctaccctagactaggtcttagatcttgaataattccttcagctttcttggcaaatgctttcgcagtagttagtcttcaataaatccaagaatttcacctctgacaattgaatactgatgccccccactgtccctattatcgatcctttagtccttcgacgtgtgaagctagaggtgccagaaaagttaccacagggataactggcttgtggcggcaaagcgcccccgactgtccctattaatcattacggcggtcctagaaaccaacaaaatagaaccacacgtcctattttattattccacccccgactgtccctattaatcattacggcggtcctagaaaccaacaaaatagaaccacacgtcctattttattattcccaagaatattaattactatagttattctaatactaagattagtttaagttctttatatagtttatattatataaatttaatttatatatatatattatattctataattatagtttatacttctttttatagatctagataattatagtattatttaattctattaaatatttttttagcttcttagtattctaagagtaaatatttatagattttcttaagaagtattattcttactttttattataatttttctaagctaagaataatatctatctggatcttagtatatattatttccttaagtatagcttctaaagttttttatactaagtattctttattatttatagtaagtaactatctattagtcttagatatagtttatttatattctaatttatagttaaggatattagttcttctattttctaattctttttaatatattattttataattaaattaaaataaatatttagtataataaatttattttctattaaattactagattatagtaaaatattaaatattcttataatctatatatactttaactttatatattatccttaaatagtagtatttaaattctttaaatatatatataataattataaactccttattataaatagagtaattaagttttatattatatagtttttttaaaaaaaatactatagggtatagtattctattattattcttttaactaagttatatactaattataaaatctaaaatattagttttaagttttatcttttttatagaattaaatatttataatataagttctaaaagtatttaatctttaattttattaaatatttcttattatttattattctattagaattctatttcttttttagtaatattatataagggtatagtaatttttctataattcttaataaattattaataataattaataaatctaagaaaaacttatacttttttaatagtttttaatatttcttatttcttaattataataatcttatcttattctatttatattttatttaattaaatagtatattctaaaaagttaattttttatatatagaaatagtttttctctagttctactaagagttttatattttctagtttctttaagatcttatatatatattccttatatctttctagattatctaaaaagattaaaatattattaagataaataactataaagatattaaaatacttttaaagtatttaattaattatttattagaatattataaatatatttattagtctaaagggtattataaaatacttatagagattaaactttattctaaatactattttctatttatcttttttcttaatttatattagattataagttctctttagatctaatatagtaaactattatttcccttataattaatctctaagttctataattaataataagagtattctatttttatatataatcttatttagctattaatagttaataactagatagagtttattatttttctttaatataaatattataaagtattctatagagaaagttaatagttatatataatcttttattaatatattattaatatatttatagagtatttataactaaggttctataaagttataaagtttataaaaaactagttcttttttattaataatagagatcttataattctactagctatattctaataagctagttttaagagtttttttaaatagttttttataaattctatatttctctagaatattttttaattattttttcttttctacttattttatctatttatacttatactagatattttttttttattctattatactttttattagttatttatttagttctacttttagattctaatactaaatagctctaaagataattttactattttcttttattattagctatatttaactttatattcttattattatttctttattagatatttctaattaattaatactaaatctatatctaagagttatttttatttctatatttattctaaaatctatattatttattttaattcttattataataagttttttatagttctagattataatactattaaaactattactattatatctacttattattataagttattattattttttataatagtatctttagatattaaaaaataaatatatttttcttcactgtataaatgctggcattataagcaataacagtagttattggtttccttctcttgactttaaggatccccgtacacctaaaatcaaatcagtcgacgacccgatgagcagatctccccagtagcgccagctcgaatctcgacttggagcagggcgatatcgttaacgtaaaatgcaccacgcagccagccaccagggccgcctgtattggggaaatcgaggcgaaggacggcttaccctcagcagatcgtaacaacacggctactctactgcttacaggaccgtttcgcacagctaagtcgtctgcaaaggatttgaccccgctcgttttaaaattatctttgcagcttacgcctctgacggcagctcaagaaagctgtttaaaactggggacgaaaataagcctgtatcacagcataatcatggaaatgaagacggccattagctgtaccatactcaggcacacaaaaatactgatagcagtcggcgtgtgaatcattagccttgcgatggaaatgaagacggccattagctgtaccatactcaggcacacaaaaatactgatagcagtcggcgtgtgaatcattatccttgcgagatgttggctgttttgggccactgaagaaggcctatggtaaagaaattgaagggataatgagagcggggattacacacacaacgaaggcggacttcctacccgcgtttttcaccgcatttaaagctgcaatgacggaacaaactatccagggcgcttttaacaggcatacctcagggttctaactactctccgatcctttacctattctataatgcggaccttatcgatagctgcaatgatgtcgaggatatcacgacaaagaaaagttaccacagggataactggcttgtggcggccaagcgttcatagcgacgtcgctttttgatccttcgatgtcgtctcttcctatcataccgaagcagaattcggtaagcgttggattgttcacccactaatagggaacgtgagctgggtttagcccctgctgcctcgtctggggcagcctgatagaacagcttccgatcttccaggtgttccagcaagtattccatgcctgtcatcacctcccgtcatcagaggcgttccgggctgatagctcttgacggccgggtcaatagccagcatattgttgatctatattcagctatgttgcctgatattgttggtccaggggatatctttatgcatgataatgctattttgccttcaggttgcgtacgagagtaaaccaaggtctaataacctttggatcttcgcatttggccctctgatagttatatttccgaacccagcaaaggagattaagaacaagagtgcagaataaggtggatgctagtgttctacagacagccgacctatggtgcactagcttttgcgtcaagtttcgtagcgcgctctttccccagttaagtcatccttgggtttctaattaaatatagcccaggaaacttcttgacaccaaaacggctaatctatattttctaattatagaaagtaatatatttagttttagatttattagaatataaactaataatatatttagattatttaataagatatttattataaagaaagaatactaattagtaaagattaaatttaaaataaaaactagaatttaatttataaaaagaattaatctagagtttaatagtaaaagaatatctctctatagtataactattaagtttatatagaaaagctaagctaatatattataaataattataaaagatctaaatatagaaagctataagttctaaagagtataaagtatatagattataagtattatataactagaggttttatataatctatctataataatatagacttaataatccttcatgaacttaatccactgttcaccataaacgtgacgatgagggacataaaaagtaaaaatgtctacagtagaggcaatagcaaggccacgacgcaatggagaaagacggagagcgccaacggcgtccatctcgaaggagtcgccagcgataaccacgtcagaaccgctgcgagcctccaccagagtttcctctggcttcaccctatacaggcatagttcaccttctttcggggccggccccgtatgctcttactcaaatccatccgagaacatcaggatcggtcggagatgcgccgaagctctctcctacgtggagagctctgctctcgccggcgctggatgggttctgtggatggatggccgctggctaaacttaccactgagcaacgggcgatcgccacgtgcagcggacaccgccatggttgaagctgtgcgctgagcactcctcttggggcgcccaagccgcaccgggaccctgttgagcttgactctagtttgacattgtgaaaagacataggaggtgtagaataggtgggagcttcggcgccggagaaataccactactcctattgtttttttacttattcaatgaagcggggctggatttacgtccaacttctggttttaaggtgaccttgaaactcaaccgctgcgcctagcacacgcaggtttggcggcgaggaatgtgttgaaccggtgaggaatgtagcggttgtggtttctttattaaggtcgtatatcgcggctgctggcaccagacttgccctccaattgttcctcgttaagggatttaaattgtactcattccaattacaagatttcaccggcgccgaagctcccacctattctacacctcctatgtcttttcacaatgtcaaactagagtcaagctcaacagtgtcttctttccccgctgattctgccaagcccgttcccttggctgtggtttcgctagatagtagatagggacagtgggaaatttaattcttttctatttaataatactaattaatataatatagtataaataactatatataaataaatattagattaatattaaatctatattattcctaataaaaaccttctataagaggtctagagcagaagtcttgatgtatgattttatcagggaatgaattccttcagccctaggaagtttatcagtatctatcccctacggctccatggccctataatctacctgccttgaggtagcaatgttgccgaaatgcaagtatttatctacccagaggtctagagcagaagtcttgatgtatgattttatcagggaatgaattccttcagccctaggaagtttatcagtatcatcccctacggctccatggccctataatctacctgccttgaggtagcaatgttgccgaaatgcaagtatttatctacccattgtcactacctccccgagtcgggattgggtaatttgcgcgcctgctgccttccttggatgtagtagccgtttctcaggattgtcactacctccccgagtcgggattgggtaatttgcgcgcctgctgccttccttggatgtagtagccgtttctcagtctccttctccggggtcgagccctaaccctccgttacccgttgcaaccatgtttggccaatacccaaacatcgaaagttggcagtacgctggcttcttagagggactatcggctcaagccgatggaagtttgaggcaataacaggtctgtgatgcccttagtgcggcgaggtcatcagtagggtaaaactaacctgtctcacgacggtctaaacccagctcacgttccctattagtgggttaacgttgcactgaaagacctgaaagactgatctagttcgtttcgggaagtatagtgatgatttccgagcgtagaatagttatctctttggtgcagctaagggagcagttgggtatttctccacttttgttaaaaccctcaagccgtgacctcgagcttacacagtgggctataacactcccgagggagccacattcccaaagcctttatcccccggggcgaactgatgctggcctggggtctgcctctacgatacgataaagcgagctaccagtggtgcctagactggaagcagatgggtgcacgctgtacattatccccagggtctagagattggactaaggaagagatgatggcctacctagattggagtaaggcggaagatgatcgggttgaggctcaggtagccgcagagatggaaagcaatcctttttctagtcgccgttgttcgccgcatccatcatcctccatccgtcgctcggcatgagctatctagaggcgaattgggcgtcggaagagcagcttgtgtgggtaagggatgccaaaatcggactctctgactacctcgaccgctggtaccgctgcaacgggccggctctaagatgtgtattgtaactggatctaagcgccaaaatagttgacgtgctggcgatttatgaatgaatggatgaacagttggcgaaccgatcgattgatgatcgattgtagtactgatgggataggttcaaacaaggggaaaagtacataccatgtgagacaccttcgacgagtcgagtagtttgggaatgctgctctaaatgggaggtatacgtcttctaaagctaaataccggccagagaggtcgagccctaaccctccgttacccgttgcaaccatgtttggccaatacccaaacatcgaaagttgatagggaagaaagttgaatgaaccatcgccggcgcaaggccatgcgattcgagaagttatcatgaatcaccagagagccccgaagggcattgggttaccctcaacagtgatactggcattaagagcgttagttagaatttagttacatctggtttgtgtgaaactcatactaaaggatttgaagcctaatttattccattttgggaagtatagtaaaatcgctgagcagtattacggttatctatatggacggagccataaatgtctagccgagcgaacttatcaaggagtgcatcgccttcttcttcgacaacctatacccccagctaccgatcctcgaccgcaactccgtggaacagcaggtgctttacatggagcagaaccctggcgcctactgcctgttgacttcgctctgtgccttcgtcatgcggccacataggaacccagtgcaaggcaacaatcaaatgcggctactgcgcccaggaccatgcgactcgagaatgcccaaacaaagccaacaagaacatgcggaaatgcgccacatgtcatggagaccatgaagcctggagcaaccattgcccggaccggaaggaagagatgaatagaatcattcggttggtgagttgctacacagtccttagcggattccgacttccatggccaccgtccaactgtctggatgtactaacaccttttgtggtgtctgcgaacccagcgcgtacgaagctctggttgccgcttgataaagttggaagcccaattaactccaacagggggcgcgccgcatacgtatagcaggatattagccatttcctcaacaccacatatcctagggggaaatgcacgtgtagatagctcaattacgtacgagacaatagcctcctcttcagattttataagattcgcgttatggtttaacagatgtgccgccccagccaaactccccacctgacaatgtcttcaacccgggtcggcccgcgaagcaccttaaaaccagaagttgtagcccgaagtcaccgtttgaggcttttaataaaagtggggaaatacatcgctgtagctttcgatgcaccaaggagatgctcgtaaattttgagccaatccagtcattagaatgtgccccctcgcgatatgcgggcttccccatatagtaagtttacttcagaaaatgattttatggcgttttcttgagttctgcttcaagagggttggtgtgtactttaggacactgtccagaacgcttgatgaatgcatcgatgagtgcgaatcggcccgggaatctacaagtaagttccaatgcatgattctatatcctctacatgccgcttcaagtaccaatgaggatgaaattgttctagcaagagggtcttcctttcttcctccagctttttcaaggaatgtgcacacggtagtccatgcgatgatgtgaatctctggctacagggagctttgagcgctggaatcaaccgttgttgtatcaacgacccgtcttgaaacacggaccaaggagtcgtcttcgtatgcgagtgttcgggtgtcaaacccctacgcgtaaggaaagtgaacgtaggagagagcttcggcgcatctccgaccgatcctgatgttctcggatggatttgagtaagagcatacaaaacaagaattaagtttcctaggcgggcgcctgatccggggcacacgaggcgcccggggcaatcccgccgaagcaacagacgtaatagcacatatcgtatcctatttccgtctcctgctgttcttgtcgtctttgctggtaaccccgaccctgtcatctaatggcagtgcaacctctgggctttctcattcgtgagacggatcatcatgaccatccccatcatgaccatccccatcatgaccatccccatcatgaccatccccatcatgaccatccccatcatgaccatatccgctgtaattaatattctttcttcactgatccacagtgaaccttccctttagcatccacccctgcagacgcgaatctagcgatcgaaagaggaaaagcactttgaaaagagggttaaaaagtacgtgaaattgttgaaagggaagcgttcatgaccagacttgggcaggtaacttaattactctatctataataaggagtttatagttattatatatatatttaaagaatttaaatactactacttaggaataatatataaagtcgatcctaagccatagggaagttccgtttcaaaggcgcactttgcgccgtgtggcgaaagggaagccggtcaatattccgggatttaaattgtactcattccaattacaagatccaaaagaaccctgtatcagtatttattgtcactacctccccgaggcgggattgggtaatttgcgcgcctgctgccttccttggatgtagtagccgtttctcaggctccttctccggggtcgagccggagggaagtgagaaggccagtatttcaaagagctcgcgaagctgattattctgaccaccacttcaaaaaaagtcatgtatatcggctgcataataacgcagccgtttgaagccgtttgagatgtatgatatctcaacaagagcatatatcgtggcgttgaaagccacgagccggcttagcagtcgggaaagggatttaaattgtactcattccaattacaagatccaaaagaaccctgtatcagtatttattgtcactacctccccgagagggatttaaattgtactcattccaattacaagatccaaaagaaccctgtatcagtatttattgtcactacctccccgactcggggagattcagattccgctgctgcatcgaagttcagacaccgacgcacagggtcctcggatgctcgtcgatgttgacaagatatctagcttcacggaactaggacgagtttccgcgcagaactataccctcaacactctgcagacattggctcttcaacttgcattatacgaggctgggtatctcacgaggcattacggaaggttgaggcgcaaaggaagcggcttcagcaggacagacttcccgcctgcacaggagtcttctcagcaacaaaagtcatgtatatcggtcgcgcggtttggtggccgtgaggcgatttttttgatttcccatacaaatgaattttgcggaaaatcaaaactggaaacggtccatagtgcaactggattgacctaacaagctggaataagaaaaggaggaggcttttccaactagatgtgaggcccttgtggatgaagaattccgagagacctggcgtgagaattattccttcccgcggattttcaagggacgtcgagagcgcaccagacccagcagaggtgctgggcgcttccggccattaaaccctagctccggacaaaccgatttcagggtgatagaccgttaagaagaaaagagaactctgcctgtctcgtcaaagttgtataggtcctcatctaggatgccgtattttaccttcaggttgcgtatgagagtaaaccaaggtctaataacctttggatcttcgcatttggccctctgatagtcatatttccgaacccagcgcgtagtctcgtcaaagttgtataggtcctcatctaggatgccgtattttaccttcaggttgcgtatgagagtaaaccaaggtccaataacctttggatcttcgcatttggccctctgatagtcatatttccgaacccagcgcgtaatgtgcgctactgtctgtcgtccctcgccgcagtcacatctggggtcagcaatccccggcactctttgcttaaagaggaagtcccgcattcctatcttctctgtccggagctggatgtatatggcgctctgccttttgctgaagtgctcgtgactatttaagaggtttaaactatggatagcggcagatccagcctctacactagcttttcgaatttctctatacctcttatactattaaaactttctatctctaaaatatggcaagatttaatagagtaaaaggtttgcaaacctttaaaaagaagacttaaagtgtaggtcatgtgaggtgcaggttatgtaaagtgtaggttatgttgagtataggttatgtaaagtgtaggttatggtgagtataggttatgtaaagtataggttaggtggcgtgtgttgtgtgtgaatatgctttggtggcataaaaaagtcatgtatatcggtcgcgcggtttggtggccgtgagtcgatttttttgatttcccatacaaatgaattttgcggagcggcaagggaatcaacaagaagctggctatcatgctggataaagataagtgctggtggatatggaactctccctttcacaacactttctaacttcaaattggttatcatagacagatgttgaggtcgaatgagagatgctaagttttccatgataatcggacaggcatcttgattacgagcatagccacttgagtttagctcgtgtggccagcgtggatctagagtggaccagaattcaagtgcgccgaacacagcaccagcggcagggccaccgacgccgcgcacggcaatccaccttccccctctcagttccccagggcctccttccaccacaccaagaccactagggccggtgcggcttgggcgccccaagaggagtgctcagcgcacagcttcaaccccgactaaaaactactctaaaacccgctaaagctgcttcccgggccacttttgattttccgtaaaattcattactataggaaatctaaaaaaatcaactcacaaccaccaaaaccttcaactgatatatatagcttttataagacctacttttatctgaaagaggctcttaagctgatcagttgagtacagaacccgcctcccctccgaattggccaggcaagcctccgcctcctcgccgtcatcgtcgccatcatccatatctctctacttcctgattcacttgttaaaactgcaagaaatcctgaccgacgtggtggcacactacaacgacgacgagtctgccaccagaacccgcctcccctccgaattggccaggcaagcctccgcctcctcgccgtcatcgtcgccatcatccatatctctcaacttcctgattcacttgttaaaactggccattcagtaactaattctccagtgcccctcgtgggcgctggtggccaaccccggcgaacgatagttacctggttgattctgcggtgttagtacatgcagacagttggacggtggccatggaagtcggaatccgctaaggactgtgtaacaactcaccaaccgaatgtactagccctgctctaaatgggaggtatacgtctgctaaagctaaataccggccagagaccgatagcgcacaagtagagtgatcgaaagatgaaaagcactttgaaaagagggtagtaatatagtgttttaaacggctataaataagcatttaaacggcaatttgttatatctctgtataaaggaagaaaaaggctggttggacgtgtcactcttgctctcccatttgtaatttttgctgtatcccaatatacctcaaaaaaaagggggagggaggaatatagatccgcccctccgcacaatcaatatacccattctccgaatacattggccactctatattatgtctgtaatgacgatcgatttgcacgtcagaaccgctgcgagcctccaccagagtttcctctggcttcaccctatacaggcatagttcaccttctttgcgttgccgcgcaaaacccacatccaggtgccggaatattgaccggcttccctttcgccacacggcgcaaagtgcgcctgtgaaacacaactagaaaggcaaaggtagcgaactcctagccttatgccacgtaaaacccggacaaatcaaccccatccatactccctacaccaggacttggcatggtggcttgactgcatagcagattggtagttcgggattttgttttggtaggaatcagattccaacttggaaatactttcataacgtaacaaacggacagcaaagaggttgagggactgattagaactgtccgcttcatcatcgaccaagtttttgcctgcctgctcccgtttttcaccatggcctggagaggggcaatagtccccgttggatccttgcgtaaacgccagcatgcttatgtccacccccttctgctctgcccgccccaaccctctgccctctttcatatctctcgggctgatgagaaccgcctggcttgcctgttatagctatagtttatatatattagtaatagttagattaattcttatactaaactattatatataatttatactattagtaataagttattgtcgtcgcgctcatcaagggggaattctgcatcgactgtgtcgtcgccttctgatcggttggcccagagcttggcgtccctgcgtgcgtcctccgctgacttgctgaggagggagatgttggagacgtgaaaacgtagccggtgacagagagttataactagagtagaatataatagtattctaatagttattaatagatttataaagtataaatactttattctatataaggaaataagacgtgccttccgagttccctggaacgggacgccatagagggtgagagccccgtacggttggatgcctagcctctgtgaagctccttcgacgagtcgagtagtttgggaatgctgctctaaatgggaggtatacgtcttctaaagctaaataccggccagcccctagggcgtggtgttggggatcggccaaagcccgcgagggacggccggcccctaaatctagtggcggacccgtcgtggcctccagcccgagcgaatattcgtatctgttagaccgattaatcgagcctttgcataacactgaaggaaggtcatcttgctgattggcgatgaatcaattagaatatccttcttcgcaacacatccaggtgccggaatattgaccggcttccctttcgccacacggcgcaaagtgcgcctttgaaacggaacttccctctggcttaggatcgactaacccacgtccaaccgctgttcacatggaacctttccccacttcggtccttcaagttctcattatgcaaaggctcgattgatcggtctaacagatacgaatattcgctcgggctggaagggatccggcttgtggcctgttaacgtttcatagtgggcgtcgaccctcacgaaagcggccgcgtgcggtacgtcgtactgaggatgcctggtctggggagagctctgcacgtaagtgtcacgtgttgcgcacccggtgcgcgtgtaaggaagttatgtaagcctaatctccttgtaagccggtcggggaatctttacaatctttacaatctttacaatctttacaatctttacaatctttacaatctttacaatctttacaatctgcttgcccgatccatcatcacactgtcccgagccgcgacctggcaaggagctttccattgactttcgtggatataggtctatctcgcaatccctcaatctagcaggaagctgccgatttcggtctggtcgccctcggggtagttcggcctgtgaatcgggtttcgcacagctaagtcgtctgcaaaggatttgaccccgctcgttttaaaattacaatacgcgaaatactacagcacccttctagtaccgtagagtaatcgcctgctaagacgctaagccgaagcctattcttgtccatctgtacgtgcgggtggtattatactttcagcctgggtatagatattaatatcttaaaaactctaataatagaagctatttatatagctagatatatataaataacccagctatagctatagctcctaagaggggaagcttattatctaatatccagtagaacaaaagggtaaaagtccccttgattttgattttcagtgtgaatacaaaccatgaaagtgtggcctatcgagcaatcaatgagccgtctgcttgatgacacgtataggtgcaagaaggatgaggtcaggcaggagctttcagatgcccttggcaaaatccatctggggttcgacctaatggatgaaggcaatatatagcccccgggtccctaatcattcgctttacctcataaaactgagttcaatactgctatcatgagggaaactttccgatcacacgcaaatacaaccttgactcgaccgtttggggtttttgaggatttccccgtcgtgaaagcatagcctcctctaagcttcgcccaagagttaatggataaaaggagagcctccctagagtcgtatatgccctcgggcgggagtacatgctaaccggcacgtcatagtgaactgccccagaaaccttaagttatggcgggcctgcatatatgacgtcacgacattttccccttttttttttcgccctactcggtgaatagaggcagaccaatggcaacttccgaatcggaggtcggagaagccaaccccttctgtcaatcctcattgtgtctggacctggtgagtttccccgtgttgagtcaaattaagccgcaggctccacccctggtggtgcccgcaaaaaccaattatctgaatgagcggttcctctcgtactaagctcaattaccattgcggcgaggtcatcagtaggggaaaactaacctgtctcacgacggtctaaacccagctcacgttccctattagtgggtgaacaatccaacgcttaccgaatcgccgagcgtatgccgcatgacctttcccatcttggcttccttgctggtcagattggtcgtcttattaccatttcaacttctccggttatcgctggcgactccttcgagatggacgccgttggcgctctccgtctttctccattgcgtcgtggccttgcgaaagaggctcttaagctgatcagttgagtatagatattagatatcttatctttaaagctgaaggaattatccaagatcaaagacttagtctagggtaggctagctatagggtagcctgggtataggttaggtcgtctgagaatatcctaggatttttcccggattttctagacccttatctatgccgacttggttggcgatgtccgagtaagccaaccgatatatttgatgcttgcatttgggataaagggcttgttttcttgcaatatttcatctctgttatgttcaaagtcattcatgttgatggaactggtccggatcccatgtgcgaggataccgtggaccttaaaaccagaagttggacgtaaatccagccccgcttcattgaataagtaaaaaaacaataggagtagtggtatgtcaccggcgccgaagctcccacctattctacacctcctatgtcttttcacaatgtcaaactagagtcaagctcaacaggctacctagattggagtaaggcggaagatgatcgggttgaggctcaggtagccgcagagatggaaagcaatcctttttctattggtagaagaggcatgcgagagatatgggaggcggctgcaaaggatgacagagagcagcagagcttatattcaactaaaactcacatagtcagcatgatccatgccagggtagctgttttcgctgaagcccgaaagaccgccagagacataaactgtccgcatatgcttggccatctgactcacggcgacggggtcagtcgcgccaaaagtcagctctgcagtgccctttgtagctataaagaattatataataataactattatataataatctattaataagtaatataataagttatataacaataaatgttatataatatatacataatagaataaactactttttataaacatatactaaaaaataaataactttaagatatataaaaagtcatgtatatcggtggcgcggtttggtggccgtgagtcgatttttttgatttcccatacaaatgaattttgcggaaaatcaaaaatcagtattcaattgtcagaggtgaaattcttggatttattgaagactaactactgcgaaagcatttgccaaggatgttttcattaatatacaccggcccacatttaccctcttgcacgccacggtcagttcccgggccagttttgattttccgcaaaattcatttggatgggaaacccttaacgaggaacaattggagggcaagtctggtgccagcagccgcggtaattccagctccaatagcgtatattaaaggtgttgtggttaaaaagctcgtagttgaaccttgggcctggctggccggtccgcctcaccgcgtgtactggtccggccggttcgaatgtatcaatactagtgggccatttttggtaagcagaactggcgatgcgggatgaaccgaacgcgaggttaaggggccagagtagacgctcatcagacaccacaaaaggtgttagtacatccagacagttggacggtggccatggaagtcggaaggtccgtcaaaatgacagacgggagatcacgctgatagagcgatttgaggtgttgtaatgcccatgagtagtcttcttccgattcgcctgagagaaaagcaaatgcaatacatctccttctccagtatcttaggcgatatagccttcagggtagcttagaagagatgggatggcgggtttacaaaagtcacagctgcaaaaatctacatggtacctcacagcacgcttagcgcccgcgttaagggaacacctgccagacgcgatattatgcccaattctcttatttttttttatactaaataataaaaatattattaataatattataaaacaacatacaataatcataaaatataaacatgggaaagtttgatttatatatattataaatattatgtatacacaattatatatagttacattatttgtaacttttttaaaataaagatatatcctaagatcaggtaatatataatctgatatatattttttaagaatataattagcagtctatatctaaacctttaatactataagataaagttaaatattatacttagggacgtcgagagcgcaccagacccagcagaggtgctgggctcttccggccattaaaccctagctccggacaaaccgagttcagggtgatagaccgttaagaagaaaagagaactctgcctggggcccccgccgtcgtctccgcgttcagttgcgttgctaccaacttctaggagcctaacctacacccagattaccctataaccaagcctaccctagactagaccttagatcttaaataattccttcagctttttagtaaacgattccttgacttcgtcagcataactgtgttagagttcttcattatttttcattcattctttttttttatttcttttatttattagtatattaatagattataaaaatgttgggtagtaataaaggattattgtgtataacctttctatcgtgctctaagatgtgtattgtaactggatctaagcgccaaaatagttgacgtgctggcgatttatgaatgaatggatgaacagaggagttttggattaaaggcccaactgtcccgcccagcaccttcccttcttagtgctcggctgggcaatgctactgtccagcttgtcagcttgtcagctctttagatccgataagcgttagatggcaagctcactgagtacgccaaaaatgaaaaaaaaccttgggcctggctggccggtccgcctcaccgcgtgtactggtccggccgggcccttccctctgtggaaccctatgcccttcactgggtgtagcggggaaacaggacttttactttgaaaaaattagagtgctcacactttacataacctgcacctcacatgacctacactttacataacctgcacctcacataacctgcaccccacaggctatctacactttacataacctgcacctcacatgacctacactttacataacctgcacctcacataacctgcaccccacaggctagctcaccgcctgtagctcacgctcagtagaccggccctccctgtatctagccactgtcctcgacttacagcgcttcccacgggtcgacgcccactatgaatcacccgccagcgaagccgaagccgtctagcctgtccaagtgaccactcagtgggaatctgcagggtcgacgcccactatgaatcacccgccagcgaagccgaagccgtctagcctgtccaagtgaccactcagtgggaatcggcattgaggcgtcgttcctcggggacgacgcgcggctcggactcagggattgatgcttcacgcgtggtgatggggagcgtgatatcttcgcggccgatgatgcttggctggtcggtagtcctgcggcaattcaacgaagtatcttccgcggcggtgctctcacgagggtgactcgcagccgccggtgaaataccactactcctattgtttttttacttattcaatgaagcggggctggatttacgtccaacttctggttcgccggtgaaataccactactcctattgtttttttacttattcaatgaagcggggctggatttacgtccaacttctggtgttaaggtccttcgcgggccgacccgggttgaagacattgtcaggtggggagtttggctggggcggcacatctgttaaactttctgtcaagtatggaaacaatgtgctggttgacagcacggggaagcctgaggttgcatttcgcatgccgtttggtgggctgcagcttggcatgaggtttccctcgtcgcaagtcgcttgtcaagccgatgctacgccgacgcagttaggagatgccttatgtaaagtgtaggttatgttgagtataggttatgtaaagtgtaggttatgttgagtataggttatgtaaagtatagggtaggtggcgtgtgttgtgtgtgaatatgctttggtggcattcccagtgaggtgcatgtgctgaagtttggttcccggcgaggtcatcaggagggtaaaactaacctgtctcacgacggtctaaacccagctcacgttccctattagtgggtgaacaatccaacgcttacctctttgaagcagtgtacagttttcaaagagcttcgtcggtttgagcccgcagaagctccgaatgacctgccagacgcaaaaggtcgaaagaaggccgcatgcccagccattcttttggtcggggacagggcagcaaactccgaggaagttgtaccttccagaatgatatattccttcttttcttaccttcgcattcatcgtacgtattacagccgcttgatatatcagtcttttcgccggttaagagagcctattgcgaggagcttgcgaagaaggatattctaattgattcattaccaatcagcaagatgaccttccttcagtgttatgcaaaggctcgattgatcggtctaacagatatgaatattcgctcgggctggaagggatccggcttttaaactatagtataattagaagtatatagaagattaaataatatatatatataatagctagattaaataatataataattaaaaatatagaaattataagaaagttaagtagaaagtattagaattagtaatatatagtaataataatataaatactattaaattatacttttaataatactacctgcctgagataaggcagccctgggttctaaagacaccacagactgcgtacgaggcaagcatacagtctgagcatattaaatcccgaatctcagctcatcaaaatagctctccaacctctatgctggctgtccatccgagaacatcaggatcggtcggagatgcgccgaagctctctcctacgttcactttcattacgcgtaggggttttacactctagatagctcatgccgagcgacggatggaggatgatggatgcggcgaacaacggcgactctccaagcttggtgtagcactcgttgagtttctgccatgcggtgatgattgagagtctcagatagcgtcggtggtcctttcccatgccgtcagttccccccgttgccgacccggtgctcccaatcctcggcgaactgtcggagcacctccatgtcggaggccgtagctgtcttgatgctaagatcaccgctcttcaccatattccaacgatgacgaggagggatcttctggatatcaggaatgcgcttgagcgcaaagaactcctttactcgatcagctgtagccccgttgacccgaaggaaatcaattctcttgccttggagcgttctaacctccgggttacggcgtaagaatgctctcaatctgtcaatcctcattgtgtctggacctggtgagtttccccgtgttgagtcaaattaagccgcaggctccacccctggtttccaaccccagcgcacccaacccactacataatcaaccacagcgcacccacaccaccacaaatccaaccacagcgaatgcccctcaaacccagtcgatggcggcggagtctccgagaggctcaacggccaagtcagaggcacgaccagcgtcagacgccgagagcaacagcaggccaagaagctggggaccctgctcaaagtactacgaacgtcacgtccgacagaggcaatgtaggtccactgcactagaggccgttcaacccgggctcacgccctaggcttcgtcactgacctccacgtccgcctactcctcagggcaccgtttctaccctgagggcgaggtatgggtgagacgcttgagcgccatccattttcagggctagtacattcggttggtgaacgctcttaatgccagtatcactgttgagggtaaccgacatcgccaggcaaccagggcggctttcgcgttcttagcaaacataaagtagtagagatataattgttcaaccctcgataaaagcattaggatctctgtctattcttttccatctaagacgccatagcaacgcctaaagtgaagccataagatgaacctcgtaaccactgtagcagctgcattagcggacctcgtgtccgctgtagcgctcgcattagcggacctcgtatctgctgtacgagaaccttacagcggttacgagcccgtattacagaaggcaacaatattccggcacctggatgtgggttttgcgcggcaacgcaactgaacgcggagacgacggcgggggccccaggcagaggtctcttttcttcttaacggtctatcaccctgaaatcggtttgtccggagctagggtttaatggccggaagagcccagcagaatgtatcaatactagtgggccatttttggtaagcagaactggcgatgcgggatgaaccgaacgcgaggttaaggtgcgagagtagacgctcatcagccgccatggttgaagctgtgcgctgagcactcctcttggggcgcccaagccgcaccggccctagtggtcttggtgtggtggaaggtagcctgcattaattagctatagcctgaaggcacaactaacgcctccagggcacagccagcctccagagggccctttatagccagatgacagatgacgaagagatttcccacagcggatcggaccagcttgttacagttgacccgagacgctgtgagtggtttgctgcagcgccttaggctgaggtgctgggctcttccggccattaaaccctagctccggacaaaccgatttcagggtgatagaccgttaagaagaaaaggaggtgctgggctcttccggccattaaaccctagctccggacaaaccgatttcagggtgatagaccgttaagaagaaaacagaactctgcctggggcccccgccgtcgtctccgcgttcagttgcgttgccgcgcaaaacccacatccaggtgccggaattacaaaagtcatgtatatcggtcgcgcggtttggtggccgtgagtcgatttttttgatttcccatacaaatgaattttccggaaaatcaaaaaagacctctatctgtaacaagtatcatgccgaaatcactacaaatccgaggagcgggcaagattggcatcaaggatgtcaaaaaaccgtgtccagaagggaatcaaattcttgtaagtggattactatcataggactgaggctactcttcagatgtagtaattatccccctattgtttgaggcaagatatcttaccatttcctcatctaggtgaaagtggttgcttcgggacctcaccgcctgtagctcacgctcagtagaccggccctccctgtatctagccactgtcctcgacttacagcgcttcccaccctcggctgcagggtagccagtctatctttacatcccgcacatctccttctccagtatcttaggcgatatagccttcagggtagcgccgggtatagggtagctggttgtggtttctgcctacccggtaccccaacttcaaaccggtctcccgccttccacgcggctcggagggaagtgagaaggccagtatttcaaagagctcgcgaagctgattattctgaccaccacttcaaaaaaagtcatgccatagggaagttccgtttcaaaggcgcactttgcgccgtgtggcgaaagggaagccggtcaatattccggcacctgggtgtgggttttgcgcggcaacgcaactgaacgcggagacgacggcgggggccccaggcagagttctcttgtcaaagcgaagccattcgaccaagcgcgggtaaacggcgggagtaactatgactctcttaaggtagccaaatgcctcggcatctaattagtgacgcgcatgaatggattaacgagattcccactgtccctatctactatctagcgaaaccacagccaagccatccaccagacgccatcgttagccttgatgcccaatgatatctaggcagaccttggtcttctagccaggatggccgcaactcacatagtcagcatgatccatgccagggtagctgttttcgctgaagcccgaaagaccgccagagacataaactgtgccaatctgccagagacgatagaccgcagtatagatgagcccgacagcagcagcattaactcctctaagggccgattttgcccatctccacccccgaatcgcattccagatacccatggttccatgcaccgtgatcaaaccgggaaagaaaagacccagtccatctgtacgtgcgggtggtatcaccgctttctggcatggattctgacttagaggcgttcagccattatccagcagatggtataagccgcaggctccacccctggtggtgcccttccgtcaatttctttaagtttcagccttgcgaccatactccccctggcgcccaagcactttgatttctcgtaaggtgccgaacgagtcaatttttaacatcgtccgatccctagtcggcatagtttacttgaaggaccgaagtggggaaaggttccatgtgaacagcggttggacgtgggttagtcgatcctaagccatagggaaggtccgtttcaaaggcgcactttgcgccgtgtggcgaaagggaagccggtcaatattccggcacctggatgtgggttttgcgctatatcgcctaagatactggagaaggagatgtgcgggatgtaaagatagactggctaccctgcagccgcttcccgagcgacagaccgggcgccagaactctggcgtccttgtaatccatctcccaaaccccctacgcagccagccaccagggccgccgctatatcgcctaagatactggagaaggagatgtgcgggatgtaaagatagactggctaccctgcagccgcttcccgagggacagaccgggcgccagaactctggcgtccttgtaatccatctccgccggtgaaataccactactcctattgtttttttacttattcaatgaagcggggctggatttacgtccaacttctggttgtaaggtcagaggtgctgggctcttccggccattaaaccctagctccggacaaaccgatttcagggtgatagaccgttaagaagaaacgagaactctgcctggggcccccgccgtcgtctccgcgttcagttgcgttgccgcgcaaaacccacatccaggtgccggagcgatctcgtattgcgctgtagcagctgcattagcggtcctcgtgtccgctgtagcagctacattagcggtcctcgtgttcgctgtagcgcttgcattagcggacctcgtgtccgctgtagcgcttgcattagcggacctcgtatccgctgtacgagaatccttccaccacaccaagaccactagggccggtgcggcttgggcgccccaagaggagtgctcagcgcacagcttcaaccctggcggtgtccgctgcacgtggcgatctcccgttgctcagtggtaagtttagccagcggccatccatccacagaacccagaaggtgctggatacagatctcttcatatcaccacagggtgtacctacgatactacactttagcccatccggaatgtgagtgtcggcttgtacaatggagagtgatctactggagatttctgttctccatgagccccccttaggacacctgcgttatggtttaacagatgtgccgccccagccaactaaatgaccgagtttggagagctttccggccctgagtggtggtttccctcctctctgggccagtccggacgcctcactgctaaatgaccgagtttggagagctttccggccctgagtggtggtttccctcctctctgggccagtccggacgcctcactcagcctacgaatgctagagagcctcgaaaaatacttacaattgtccgaggactagaatgaattggctgatatactagattatatctaccttgttcattctaccccggttatcccaacaaagtcaagaaactagacaagatgtcggggtcccaagacagaagggagatgatattgccccgcaacgatgataaatggcgggattgcctcacctcgggaattaatagattgaattaccgaaacccattctctacgcgatcggagggttcagagtgcagattttgcaatgggaatgttgctggaagaccttcatttagtaatgaattatcctccagctcgccgtgtgggtaccggtttgaccgcaacatggtcgactgccagtacaatttatgggcaaatcttgtaagaattaggtttaccttcctacaacaggtaatgtggaaaaaggagattaagaacaagagtgcagaataaggtggatgctagtgttctacagacagccgacctatggtgcactcctgttgagcttgactctagtttgacattgtgaaaagacataggaggtgtagaataggtgggagcttcggcgccggtgaagcgtatgcagggattagacaggaggcagaaaatggacgccgggttgctggcgacccacaagcacctgtgtcgagcagagggcctatagtctcaacctagtacgaaaaaaattgagcaatggcagccggcgaaccatcaacattagccacttgagggaggcggtcatcgtgcggtaaggcaagtaactagctctattgtgttgttgtcgagaactaacgaataggttctatctagctatgaagccagtggaaactggtgggagcggctcgtgtacgtgtccggtcgagccgggttatgtccaaggcctaagaaacagaaagtcttttttttaaaggtttgcaaaccttttaccagtgggctataacactcccgagggagccacattcccaaagcctttatcccccggggcgaactgatgctggcctgggcaggcagagaatcggtttgtccggagctagggtttaatggccggaagagcccagcacctctgctgggtctggtgcgctctcgacgtccctatatcggtcgcgcggtttggtggcagtgagtcgatttttttgatttcccatacaaatgaattttgcggaaaatcaaaagtggcccgggaaccgaccgtggcgtgccaccagagatcaagatagacctaggtaaatttggtggcataacctttactccagtccacttttcggaacatatatccacgcactggccaaccaagctcgccataccgcattcaggtcggtaattatcggtattgcggggatagtttccagcgagtgttgcttgggataaataggcgtctccaaaataaggcttccagtgtagcgcgcgtgcggcccagaacatcgaagggcatcacagacctgttattgcctcaaacttccatcggcttgagccgatagtccctctaagaagccagcgtactgccccggggcgaactgatgctggcctgggcaggcagagtgcaccgcggagaaccacggatgatcaacctgcccaagtctggtccccggggcgaactgatgctggcctgggcaggcagagtgcaccgcggagaaccacggatgatcaacctgcccaagtctgggcatgaacgcttccctttcaacaatttcacgtactttttaaccctcttttcaaagtgcttttcatctttcgatcactctaagatagcagttaaattaactagctttactatagcttttataataaaacaccagagatatataggaatattagcccataatatagagggcagaatcagcggggaaagaagaccctgttgagcttgactctagtttgacattgtgaaaagacataggaggtgtagattaggtgggagcttcggcgccggtgaaataccactactcctattgtttttttacttattcaatgaagcggggctggatttatctaaacataggtactccttcctaatataaaagtataggtaaataaaacaatacctctgtagccttctcatttaatcagctcgcaccttggaccaatgaaagtgatgaaagcctcgtatacccctctaaaacaataatttaccgcggctcttaacaacttttttgattttacataccctgcagcgcccgcgggacgccctccctccttctccggggtcgagccctaaccctccgttacccgttgcaaccatgtttggccaatacccaaacatcgaaagttgagagggaagaaatttgaatgaaccatcgccggcgcaaggccatgcgattcgagaagttatcatgaatcaccagagagccccagcccctgccgttaaacccccaactttccaaggttgacctcagatcaggtaggaatacccgctgaacttaagcatatcactatagtcatgtatatcggtcgcgcggtttggtggccgtgagtcgatttttttgatttcccatacaaatgaattttgcggaaatttactgtgaatacttgttcacataaaaaattatattttatttatgtatatacgagatacaaataatcttacaattcttagtaatatatatttagataaaatatataatattaatacgattaaaccaaaagaaaatacgatttcattcatataataaaacccacaaaatcaagaaagagctctcaatctgtcaatcctcattgtgtctggacctggtgagtttccccgtgttgagtcaaattatgcaatgctctatccccagcacgacggagtttaacaagattacccaggcctttcggccaagggagtactcgctggctccgagccttcagggtagcttagaagagatgggatggcgggtttacaaaagtcatgtatatcggtcgcgcggtttggtggccgggagtcgatttttttgatttcccatacaaatgaattttgcggaaaatcaaaactggcccgggaactgaccgtggcgtgcaacgtccgcctactcctcagggcatcgtttctaccctgagggcgaggtatgggtgagacgcttgagcgccatccattttccgggctagtacattcggttggtgagttgttacacagtccttagcggattccgacttccatggccaccgtccaactgtctgcccctctcagttccccagggcatccttccaccacaccaagaccactagggccggtgcggcttgggcgccccaagaggagggctcagcgcacagcttcaaccatggcggtgtccgctgcacgtggcgatctcccgttgctcagtggtaagtttagccagcagtttatgcgagtaggcatgacccacatatcagcactcactcgctccagttcagattgcttgatttaaactaaatgctgaggtgttaactcatggtgcttctccacaggcctgtcacatacaatgccaatcgcaagggcttgtagctcgggtaagacgcagttatcatgaatcaccagagagccccgaagggcattggtttttaatctaataaatacatcccttccgaagtcgggattttaagcatgtattaacagctgtaacccgaccatcctggtcgaagcgtattcgactccaaaacccctctgcttcaagctcattagcaagagcatatatcgtgctttgacccttttgctggtctcgcttgccttgtgcaatgcaattgtagatgtcttgctgggtagcacgagacatgatctttacgctcgtgacttcgacgatgaactcgaggagcgtgatttcgacgaatatgatctctatgagcgcgactttgacgatgagctctatactcgtgggttgaaaccgaaggtcattttccacggcaagcccgagggtcagatctttgaaaacgaagggtatctttactcacctgacgttactgttgaattcacttatagctataggcccgacctagctatcactgctaggcttactaataggctgctagttacaatagcttatagtagtaggcccaaccttactattatagctgcccccttataaattagctactaattacttagctagctaataggagatatacttaagatattagttttattagattagatttagtattaatatattaaagtttattttaatttaatttaaaattatacttatttagaaataagaaaaattagttatataaggttattagttaatttatctctataaatataatatatatttactactatagaaggtttttattagaaataatatagatttaatattaatctaatatctatttatatatagtcaggtttatattttatgattattgtatgttgttttataatattattaataatatttttattatttagtataaaaaaaaaataatctagtggtattttctcctgctgcacaagctaaagctaaagcttgccctcccggtatgaatcatacatttaatctaataaatacatcccttccgaagtcgggattttaagcatgtattagctctagaattaccacggttatccaagtagtaaggcacccataggttttgtctgtcttccaaggtaacaatcccctcatggttaattatctctggcctgatgtgagagacagctcgctgtctgtcgcttcacgccggggtgaattgtgtgaacccggtaacgaaagttatcacttttctctcactgcagtgtcgcttcacgcgaagctgtgcgccttaggctttcgccttcagcactcgcgcccctctctcataggtgcaccgacccacatttaccctcgtgcacgccacggtcggcaggaaaggactttcacaagcccaaacttaccagggcgtacgctcccaaggttcgcactgggtgtctcacatggtatgtacttttccccttgtttgaacctatcccatcagtactacaatcgatcatcaatcgatcggttccgaaaggcctgggtaatcttgttaaactccgtcgtgctggggatagagcattgcaattattgctcttcaacgaggaatcactagtaagcgcaagtcatcagcttgcgttgattacgtccctgccctttgtacacaccgcccgtcgctactaccgattgacgaaaggcctgggtaatcttgttaaactccgtcgtgctggggatagagcattgcaattattgctcttcaacgaggaatcgctaataagggtctagaaaatccgggaaaaatcctaggatattctcagacgacctaacctataccaggctaccctataaccaggctaccctagactaggtcttagatcttggataattccttcaacctgcccaagtctggtcatgaacgcttccctttcaacaatttcacgtactttttaaccctcttttcaaagtgcttttaatctttcgatcactctacttgtgcgctatcggtctctggccggtatttagctttagaagacgtatacctcccatttagacatagcattgcgatggccagaaagtggtgttgacgcaatgtgatttctgcccagtgctctgaatgtcaaagcgaagccatcatagcattgcgatggccagaaagtggtgttgacgcaatgtgatttctgcccagtgctctgaatgtcaaagcgaagccagtcgaccaagcgcgggtaaacggcgggagtaactatgactctcttaaggtagccaaatgcatagcattgcgatggccagaaagtggtgttgacgcaatgtgatttctgcccagtgctctgaatgtcaaagcgaagccactccaatatcagtcatgcctctcgatccaagccaccctgattattggacacaagcccttcagtttacagaaaccatacaccgtgatgtatatccgaccgtcgaccccacacaaccaagtctacaacgcatcgctcagggcaaggtcgttgtggtcactggagcaatatcagtcatgcctctcgatccaagccaccctgattattggacacaagcccttcagtttacagaaaccatacaccgagatgtatatccgaccaaaaaaaaaaaaactcactgcaaccatttgaacaaacacttcccagcccaagatggtcgctctgactctcttcgcgataggagggtctgaggaaaccccgccccctaactcagacggccttatcgaagagaacgaagacgcgttcagaggagattcagccatgataaccaatgctgcaggaaaggactttcacaagcccaaacttaccagggcgtacgctcccaaggttcgcactggatgtctcacatggtatgtacttttccccttgtttgaacctatcccatcagtactacaatcgatcatcaatcgatcggttcctagttttcatgaccctgatctccagagggtcgctggcgaccctttaggtttcctgaattctgatctttagaaggtcgctggcgaccttttagtcctcctgacccctgatctctaatttcgaggacccacaatcaactgggatcacgaccctcatcaaacgtatagcgactctatgccttgtagaggtgtgttgtttttatgcctttttgccttgctttccggcttcctacccccctttttttttctggttagtatttacagaagctaacgctcggttattcaagagctgttttggcaatatggcaactgccgaaacgttcagttgcgttgccgcgcaaaacccacatccaggtgccggaatattgaccggcttccctttcgccacacggcgcaacgtgcgcctttgaaacggaacttccctatggcttaggatcgactaacccacgtccaaccgctgttcacatggaacctttcataaccgtggtaattctagagctaatacatgcttaaaatcccgacttcggaagggatgtatttattagattaaaaaccactgccgctcgattgaactttagtattagctgtccagggacacctgggactggtggcttttcctgtagccgtttatgcgtggtaatggtcccgagactcttggcaaacttcaaacatgtgactggttttctatgctcctaaaacgccctggactcttttcggccacaatttctttaagtttcagccttgcgaccatactccccctggagcccaagcactttgatttctcgtaaggtgccgaacgcgtcaatttttaacatcgtccgatccctagtcggcatagtttatggttaagactacgacggtatctgatcgtcttcgatcgtagggttttgagagctatcgtcaggtcatcttctgagacagttatttcctcgtcatcacacagctgatcgacgatttcataggcgttgacgacagcttgttcagctttttcccagttgctgaagtcgatagcttctgcaggcacgtctttgatacggattttgattttccgcaaaattcatttgtatgggaaagcaaaaaaatcgactcacggccaccaaaccgcgcgaccgatatacatgacttttttttgagtttccgcaaaattcatttgtatgggaaatcaaaaaaatcgactcacggccaccaaaccgcgcgaccgatatacatgactagttaattcgttagcttcccccttaccttaagttgagaggaattgacagagtctggcataaattcatggtgtaagttggggggcaataggtatagagcactgaatattgcttgaggttgggtttaggcgcttgttgtcataaaccttcacatatccatcaggccaaccagcgctgcccacaaatcaaatgcaatcaaacaaacagccaaacaaatcaatcaaatatgccagaatcttatctccgtagggggtttgggagatggattacaaggacgccagagttctggcgcccggtctgtctctcgggaagcggctgcaggggagccagtctatctttacatcccgcacatctccttctccagtatcttaggcgatatagccttcagggtagcttagaagagccagtgaggtgcatgtgctgaagtttggttcccggcgatgtgcatgtgctgtggttggatttgtggtggtgcatgcacgcttctccatgagccccccttaggacacctgcgttatggtttaacagatgtgccgccccagccaaactccccacctgacaaggtcttcaacccgggtcggcccgcgaaggacttcaaaagcctcgtacagctgaaaaaggctgataataacggcctattgaagtggaattggggttaaatggaaacagctctaacgccggataacaaggttgatcaagctagaaaggaattacctaggaaatcccctactaacagcttcttaggtcaatcacgaatacattagcatggaataataaaataggacgtgtggttctattttgttggtttctaggaccgccgtaatgattaatagctatgagagaggggcgcgagtgctgaaggcgaaagcctaaggcgctgcagcaaaccactcacagcgtctcgggtcaactttaacaagcgcaggcctaccagatacaggccaatgttgctgcggaggattcttggaagagagctgtaagtgtattcattgcagcgtctcactctatgtttccaactaattttctagaggatctagtattccaatgcgccgccattctcgtgcttttttcgctgcttcaaaatatccctttttcactgttgtgcagctttttcgcatacctatccaacacagcctgagccttcgcaatttcatctcccttcctcttaataatcatattgcgagcctctgagaccttcacgcccaataaagaccgcatgctgtaccaaatcacgcaaaagacattgctcgatccaatgcatcctctcattatcctctcacttgctgctcatccaccggcccgttgcagcggtaccagcggtcgaggtagtcagagagtccgattttggcatcccttacctacacaagctgctcctccgacgcccaattcgcctctagatagctcatgccgagcgacggatggaggatgatggatgcggcggggccggccgtccctcgcgggctttggccgatccccaacaccacgccctaggggcatgagggttgaaatgacgctcagccaataccctgatctgaatataactaaaaataatataaagcttaaataattaatttttaagagctacctctactctaattaatttaatatagtatataatataatatattattaatgagattttgcttgcaaaccggatacagccacggggaaccaactaaaatcgaaaacttcataggtcattcaagtcaaaccagctactaagatggacatgaggtcctttaagaggatcttggcaagtggcccctcatcagctctgtggctttgcaaccacgttgtgcatggaatgaaagagcctacattttgataattagtccattttcattgccccttatctacattgttctatcaaccagaggctgttcaccttggagacctgctgcggttatgagtacgacctggcgtgagccgccttcccgaaagcgccctcgggacgacgcacaaccagggggacttctgactccgccagccacgagacctcaccgcctcgagaaaagtccgaggctgtcgcaggacatcgcccctgtccaacggaaatacctcgagaccgttctgcaataccgtgagtaagcaatttttgttattatcgcagagcctaaacgatcatattttcacttctttttgattcatattgtgggtctctccatccacccatcctaattggggtacatatctaatagtcttcaaatatctacaaggattatcggttctacaccaggacttggcatggtggcttgactgcatagcagattggtagttcgggatttagttttaactaaaaaagaagcctataaaattactagagcttaatcttaacggatatagttataatatatctaggctttactattagtctaatacttaccctagtatctaaatctaaaagcttgttacgcttcaaactggccgcaaccagcttggcgtagtagatgggatatttggagttggccacagggtagccgtagttttggatcctcacaaagagccctctgatagtcatatttacgcgatagaactgttttgaggagtggttgtctctgcacaagcgggaggcccaattgatgccaacgcgctccgcgtcgcggtcgcgtaacagcaaattcgccatatcttgcacctcacacccgctaaagctgcttcctgggctacttttgattttccgcaaaattcattactataggaaatctaaaaaatcaactcacaactactaaaaccacgagcggggtcaaatcctttgcagacgacttagctgtgcgaaacggtcctgtaagcagtagagtagccttgttgttactatcagcagtagagtagccttgttgttacgatctgctgagggtaagccgtccttcgcctcgatttccccaatacaggcggccctagcagtagagtagccttgttgttacgatctgctgagggtaagccgtccttcgcctcgatttccccaatacaggcggcccgggtggctggctgcgtagggggtttgggagatggattacaaggacgccagagttctggcgcccggtctgtctctcgggaatagatcgggcgatcgaacaaagcggcaacgaacacataaagcatatcagagtagcctcaactaaccagctcaagagcggtgatttgagcatcaagacagccacaaccgaggacatggaagcattaagacagtttgctgaagactgggaacaccggcttggcaccaacgctgcggtcagaatcccaacttacggtatccagtagtaaatatatattatacttatagagataaattaactaataatcttatataactaacttttcttatttctaaataagtataagtagtaaatatatattatacttatagagataaattaactaataatcttatataactaacttttcttatttctaaataaatataattttaaattaacaggcggactcactccaaaccagtagccacctacgtagctcgtggccgtcacaaccacccaccacggttcaaccgctaagctggttccctgctggaatccctcatcaatgtagccaatctgccagagacgatagaccgcagtatagatgagcccgacaacaggcggactcactccaaaccagtagccacctacgtagctcgtggccgtcacaaccacccaccacggttcaaccgctaggctggttctatttgacgatcgatttgcacgtcagaaccgctgcgagcctccaccagagtttcctctggcttcaccctatacaggcataatagcacaaccagaggcttcgtatgacctatctgtagcggcacagacccaacagaacccgtcagaagaggatatcaacaagttgatggtactatggttgcaaccaccactaatcttagccagggaaaatgcgacgactgtgctcacatgattggccaaagtgtgcgagctctattagcatcgtaacattccgaaatagaaacccctagtgaggggagttctacctccctcaatatataacacgaaagttaggggatcgaagacgatcagataccgtcgtagtcttaaccataaactatgccgactagggatcggacgatggtaaaaattgactcgttcggcaccttacgagaaatcaaagtgcttgggctccagggggagtatggtcgcaaggctgaaacgcagcttgattggaagccaacgacaacagcagagatctatctgtggctgggctatctagtttatatggggattcataggcagacacgatattctgactactggaaggctccccaagccggtcagcagcttccggtccatccaatagctaaattcatgcctgggggcgaaagactaatcgaaccttctagtagctggtttccgccgaagtttccctcaggatagcagtattgaactcaggtttatgcgagtatggccaatctcgcatcaacatatacgaatcaaggccggtgggaggaggcagagaagcttgggttgcaggtgatagaggctcgtaagatgaagcttggagcagacctgtagctcacgctcagtagaccggccctccctgtatctagccactgtcctcgacttacagcgcttcccaccctctaaaacacttcaagatcgaaggcctctggccaaggcaggttgcagaaagggcaagaatccgaaaaggtgaagcatttgcgaatctccgagtgcagcgcgttcgtcgggtgcttcgagcagcggctagggatcgagttcatttaatccaaaactcatcttcagcgcaattgggagtggcatctcattacgtttgactaggcctgatgattggctaaacatacagacttcggtcgatattccagaggtgggcttgactttacagacaaaagttggtcacccgggctaggctacagtctaattcttgttggctatacgaggtactctgttctacagacagccgacctatggtgcactagcttgctttttgcgtcaagtttcgtcgcgcgctctttccccagttaattcatccttgggtttctaattaaatatagcccaggaaacttcttgacaccaaaacggcatcgcgtgcgttccacactcaagttactagggcaatccctgttggtttcttttcctccgcttattgatatgcttaagttcagcgggtattcctacctgatcggaggtcaaccttggaaagttgggggtttaacggcaggggctcgtcgctctccgatgcggaatatcactacttcgcagagttacttttaaaaatgccacaattagctcctttttattatatgaatgaaatcgtattttcttttggtttaatcgtattaaaatatatattaccaagaattgtaagattatttgtatctcgtatatacataaataaaatataattttttatgtgaacaaatgacctacactttacataacctgcacctcacataacctgcaccccacaggctatctcaccgcctgtagctcacgctcagatgacctacactttacataacctgcacctcacataacctgcaccccacaggctatctcaccgcctgtagctcacgctcactagaccggccctccctgtatctagccactgtcctcgacttacagcgcttcccaccctctaaaacaataatttaccgcggtatatagcttttataagacccacttttatctaaaagagactcttaagctgatcagttgagtatagatattgaatatcttatctttaaagctgaatcaactgtaccgtatcttgcagattcccactgagtggtcacttggacaggctagacggcttcggcttcgctggcgggtgcttcatagtgggcgtcgaccctcacgaaagcggccgcgtgcggtacgtcgtactgaggatgcctggtctggggagagctcaagaaaagagaactctgcctggggcccccgccgtcgtctccgcgttcagttgcgttgccgcgcaaaacccacatccaggtgccggagcttgttacagttgacccgagacgctgtgagtggtttgctgcagcgccttaggctttcgccttcagcactcgcgcccctcagcttgttacagttgacccgagacgctgtgagtggtttgctgcagcgccttaggctttcgccttcagcactcgcgcccccctctcataggtgcaccgacccacatttaccctcgtgcacgccacggtcggttcccgggccacttttgattttccgcaaattatagtataaatagatataaaatataagtttttaatagcttactatctataaagtaatagttaaatagaatatttaaattagactctagaataatatctataagtatatattaactataaatagaataattagatataactattactaatagtatagattatatacctagctcccccgagccttcttgttaacctcgtgaagagaaggcgagaacctaggctttatcgcatgcgaaataggccgcctctcttaatccatctggacgacgatctcgtccaaggtcggagatccgtcgcttccgtcaggactagcgggccgtatcaccggacaaaccgatttcagggtgatagaccgttaagaagaaaagagaactctgcctggggcccccgccgtcgtctccgcgagatagttgtagagccatctagctctgatactggcagtatttcaagtagcttaaatgaagatagctagctaggaggcatcttgaccaggcctggccaagataataaaagaagaaattaaaccttttctatacttattttattattttatatctaaaaataatattcttataatatatctttatttaaacggccaagggagtactcgctggctccgtcagtgtagcgcgcgtgcggcccagaacatctaagggcatcacagacctgttattgcccggccaagggagtactcgctggctccgtcagtgtagcgcgcgtgcggcccagaacatctaagggcatcacagacctgttcttgcctcaaacttccatcggcttgagccgatagtccctctaagaagccagcgtactgccaaagcaatacgggctagttagcgattcccttgttgaatccatacgtggtttcacctcaatacacctttcaaacccggccctcaacgcccccgactacgccagtagccggattgaagaggaaagagatcgagatgaccaccccaaaaggaagtcaacagcttcgcggcttaatacgggattttatatgtgaaatcctttagtccttcgacgtgtgaagctagaggtgccagaaaagttaccacagggataactggcttgtggcggccaagcggtcatagcgacgtcgctttttgatccttcgatgtcggctcttcctatcataccgaagcagaattcggtaagcgttggattcgtaatgattaatagggatagtcgggggcatcagtattcaattgtcagaggtgaaattcttggatttattgaagactaactactgcgaaagcatttgcaaaaacgcctacatcaagtggctgaagaatatgagaggagtgaggaggcatacagagagtcttaatgtcattatctcgacaataggactcaaattccattgagtggtggctcagtgatagtgcatgagagatgaccagagtatagttcaatttcgatgcggaacactccaccggagcccagtgcatgtcaccagtgttttgactttgaccgatagattcagttaatcctgtcaaggactttaggcactcagacccggatcgttgtcattccacactggggagcaagccacccccaaaacgttgactaccatgccataccgatattcgccaatacccagggccttgccattggcggagttgatgacggtgatgaggtccggaacagccgcaatcactgcctcactcgctcagtagaccggccctccctgtatctagccactgtcctcgacttacagcgcttcccaccctctaaaacaataatttacccgctatgaacgcttggccgccacaagccagttatccctgtggtaacttttctggcacctctagcttcacacgtcgaaggactaaaggcaggcctttgctcgaatacattagcatggaataataaaataggacgtgtggttctattttgttggtttctaggaccgtacataacctatactcaacataacctacactttacataacctatactcaacataacctacactttacataacctgcaccccacatgacctacactttacataacctgcacctcacataacctgcaccccacaggctatctcaccgcctgtagctcacgcattgctttggcagtacgctggcttcttagagggactatcggctcaagccgatggaagtttgaggcaataacaggtctgtcatgtcgttgatgaccattacgccagcatccttgcagagcgcgaacctcagtccaccccagggtattacacagtgggctataaatgacgaggctgcaggacgaatttgacagcagccatcggcttaaccgaggataagatcttggcgtggcgtatgaagtaacgagactcttccagctttcagggagggtgacgcggaggcaaacaaccagacaaacatgtgtaccatacaaaccgttttttggacgaataaacgaacctttatggcaacccaaagagaacgattttattattccatgctaatgtattcgagcaaaggcctgcctggagcactctaattttttcaaagtaaaagtcctgttttattttattattccatgctaatgtattcgagcaaaggcctgcctggagcactctaattttttcaaagtaaaagtcctgtgtcgtatccgctgtagcagctacattagcggtcctcgtgtccgctgtagcgcttgcattagcggacctcgtgtccgctgtagcgccgaaggatcaaaaagcgacgtcgctatgaacgcttggccgccacaagccagttatccctgtggtaacttttctggcacccctagcttcacacgtcgaaggactaaaggatcgataggccacactttcatggtttgtattcacactgaaaatcaaaatcactgctagcgatcttagccactggctattagtgatcaaattagctgttaaagaccgctattagcggtcccagccactagctgttagcgatcgcagccactagctgctagcgatcgtaaccactagcttctagcgattgcggccactggccacaaccgctagcagctagtggtcaggatcgctaacagcgatctgaccccactaacttatagtggctataatctctcaaattcaacaagacctacttttatctaaaagagactcttaagctgatcagttgagtatagatattgaatatcttatctttaaagctgacgtgtcttccgatgccggcagttgctgcaagccaatgcgactctgcgcctcttgtttgggccaccaccttcacccgcactggcctttgccgatgtcccccagcttgcctgtgggtcaacttgggtcgcgatccaatagtatctccactctcgagggtcttgaagcttccttaatggccatcgacttgtctctgtagagccaaccaccacatgaaaatcaacttcagtacataaaagatccccaacccactcatctaacggagctcctccgtatgaggattgacagattgagagctctttcttgattttgtgggtggtggtgcatggccgttcttagttggtggagtgattggtctgcttaattgccccagagcaagattagccgaatgtgaatgtccctcagtattgccaagtgtagctgtctcttctcgcatgatgtcagacgggctcccagcactacctatccgagcaaaggttggagattgagttgcttcatccgcaatcatgtgaccggatacccgggttgaagacattgtcaggtggggagtttggctggggcggcacatctgttaaaccataacgcaggtgtcctaaggacccgggttgaagacattgtcaggtggggagtttggctggggcggcacatctgttaaaccataacgcaggtgtcctaagtggggctcatggagaacagaaatctccagtagaacaaaagggtaaaagtccccttgattttgattttcagtgtgaatacaatccaatgcatcctctcattatcctctcaccctgcccgaggctgcgtggcggcggcagatttggtttgagttcgccggggatagggtagctggttgtggtttctgcctacccggtaccccaacttcaaaccggtctcccgccttccacgcggatcggagattcactgaattctgcaattcacattacttatcgcatttcgctgcgttcttcatcgatgccagaaccaagagatccgtttttgaaagtttttatttatttgtaaaaactactcagaagattccaaaataaaacaagaattaagtttcctaggcgggcgccgtccgttgactattctccgaagacttcctgggaatggccccagtagttgtcgtcgaaggcgctggtatcttcggcattgtaataggacatgcaatacggtttgccaccttgctccgcagtcgcgcgcccgcgggacgccctcccatgagcctgggtactcttcagaaatacaccggcccacatttaccctcttgcacgccaccgtcagttcccggacaaaccgatttcagggtgatagaccgttaagaagaaaagagaactctgcctggggcccccgccgtcgtctccgcggtcagttgcgttgccgcgcaaaacccacatccaggtgccggaatattgaccggcttccctttcgccacacggcgcaaagtagagtgcaccgcggagaaccacggatgatcaacctgcccaagtctggtcatgaacgcttccctttcaacaatttcacgtacttttggtggaggctcgcagcggttctgacgtgcaaatcgatcgtcaaatatgggcatgggggcgaaagactaatcgaaccttcgattcgatgattcactgaattctgcaattcacattacttatcgcatttcgctgcgttcttcatcgatgccagaaccaagaggcccccgccccaggtggatcctgtacgaaggggagatcccccggcaaccccatatcagatggttgaggcgacaatgaggcaggtagaggggcatccgtggggcttaatttgactcaacacggggaaactcaccaggtccagacacaatgaggattgacagattgagagctctttcttgagtttgtgggtggtggtgcatggccgttcttagttggtggagtgatttgtctgcttaattgcgataacgaacgagaccttagaagaacggcatcgccgtcacttcgcctttctatatgtgagcctattcagtgggcttttgctgccacagcgcccgcaccaggatttcttggggtgcactctatatcctttagccgattttctaaacgctcgaggtagctgtcccccctgcattagagtctttgcaacgagccgtccacgcgcttgttcccctttcaagaagacacataccttcttcccatagtaaggctggtggcaaccccagcctctgcttcccgggctacttttgattttccgcaaaattcattactataggaaatctaaaaaatcaactcacaactaccaaaaccttcgaccgatatatatagcttttataaaggcagggaagttctataagccaaggctaccttgtctcgctaagtctaaacatgagaggcggtagaaaccccttctagtgactgcgtactccggagaggatgtaaaccttgcctaggcgagcacgagcggccacaattttgggacttgattggctcaaactttacgagcacaggaggacaacagcacgcggttgcgagaagatgtcccgtacgtcttttggctataacaacatattccacatgagctcgttttttttgcgaagcgccttcacggtgtacgctaataccttttgagtcgcgcgtcttacccgagctacaagcccttgcgattggcattgtatgtgacaggcctgtggagaagcaccatgagtccggccccgtatgctcttactcaaatccatccgagaacatcaggatcggtcggagatgcgccgaagctctctcctaccttcactttcattacgcgtaggggaaaactgccttgaaggatcgtgccaagtggccatgaatgcacgtttatgccacaccacatgtactgttggacagccagcggtatgcccgggtcggtcgatcctccttttcaataacaaccccccaagacagctgccagatttctatctcaccagatgcttaaatacggactcgttcctgaagatcgataggccacactttcatggtttgtattcacactgaaaatcaaaatcaaggggacttttacccttttgttctacttgagatttctgttctccatgagccccccttaggacacctgcgttatggtttaacagatgtgccgccccagccaaactccccgggcagggtgagaggataatgagaggatgcattggatcgagcaatgtcttttgcgtgatttggtacagcatgcggtctgtattgggcgatcgcaatgctatgttttaattagacagtcagattccccttgtccgtaccagttctaagttggttgttaaccgtacgccggatcgcaatgctatgttttaattagacagtcagattccccttgtccgtaccagttctaagttggttgttaaccgtacgcctatcgactcacggccaccaaaccgcgcgaccgatatacatgactttttttgaagtggtggtcagaataatcagcttcgcgggctctttgaaatactggccttctcacttccctccgatccgcgtggaaggcgggagaccggtttgaagttggggtaccggatcgactcacggccaccaaaccgcgcgaccgatatacatgactttttttgaagtggtggtcagaataatcagcttcgcgcgctctttgaaatactggccttctcacttccctccgatccgcgtggaaggcgggagaccggtttgaagttggggtaccggtgatgccaacgcgctccgcgtcgcggtcgcgtagcagtaagttcgccatatctgccacctcgcgtaatcggggagaaaatgcttgggaatctagatcaagaatcctctatagcaaggccttcacttcaataactccagggtgggtgtggccatgacaaatcacaagtgctccaactaggatggcgatcgaaattacatatatgcctttggtagttgaattcgtcgtctccgcgttcagttgcgttgccgcgcaaaacccacatccaggtgccggaatattgaccggcttccctttcgccccacggcgcaaagtgcgcctttgaaacggaacttccctatggcttaggatcgactaacccacgtccaaccgctgttcacaaaggactccataatcaatctcagcagggttggtttaatgattcgaaccatcggattcctctttagggaagatgcaccatccctttgggtgcgatgcggtgccagccatgtcactttttccgcttttgaccaatgagacagcgccagaaataagtagaaccgataaatacaatggcatgtcatgtcctgcctacacaagtacaagagaccaatgcgtactagctccactcatcctcgctatcctgtatctcatggtgtcgagctatcgagttgctgatcccagattgaaggagatatagcgaaggtgggctcagagggcttgtcgctgacgttgatagggagcggcattgctaggcggggatccaccatcatacggtcggcatttgtaggtgtttcagggcttttggagccctgaagataacacgttgccttctgtaatacgggctcgtaaccgctgtaaggttctcgtacagcggatacgaggtcttatcccgaagttacggatctattttgccgacttcccttatctacattgttctatcaaccagaggctgttcaccttggcgacctgctgcggttatgagtacgacctggcgtgagaattattccttcccgcggattttcaagggacgtcgagagcgcacgagtattttaaggcagtatatagttagggggaggggatattagggttacttagggttagggttagagagtattttagagcagtatagggttagggggaacataacctacactttacataacctgcacctcacatgacctacactttacataacctgcacctcacataacctgcacccccctggaagcttgggctggagagataatttggagctttcttgcggtcctgctgttccttacccttatcatcatcctcactgtctatgatggacgacctatgccaaaatggcccatgggcctcacccttaacacagtaattgagatcccatagctatattctgtatatacgttccttccaagttaggactaagtcgctgttgcaagcccggtagggtttttagaattgactgagcggccttacttttgtatacgaggctttcatcactttcattggtccaaggtgcgagatgattaaatgagaaggctacagaggtattgttttatgtttaaacaggactaaaatatcacttgcttatctccctacctttcgattcttattacctatacttttatattaggaaggagtacctatatttagatctctacctaggaggagactagagatgaaaatatataaagccgtattctccccttaaattcagcagcattaaacctaccctactaaaacaacccacaacagtatacataagcaactggaagtcagccatagcgtgtatcaccccgctaaaatgccaaccccagcgcacccaacccactacataatcaaccacagcgcacccacaccaccacaaatccaaccacagcgaatgcgatcgagagacaatatacctagaggaaaaagttgagaacgatgtacaaaatccacggcgaccacggcatctgactacaaactctgatacctatgcagctaacgataagagatcgagagacaatatacctagaggaaaaagttgagaacgatgtacaaaatccacggcgaccacggcatctgactacaagctctgatacctatgcagctaacgataagacttggtggagagatttgattagtttgacaaagagtaagggtgaacatcaccaacagtaggtatgttcacatgggtttgggagttgtaaactcggtaatgatccctccgctggttcaccaacggagaccttgttacgcaacagtaggtatgttcacatgggtttgggagttgtaaactcggtaatgatccctccgctggttcaccaacggagacctggttacgacttttacttcctctaaatgaccgagtttggagagctttccggccctgagtggtggtttccctcctctctgggtcgagttcaagaggaaaccactgctgttgaacccacttcccttggaagataataaggggaggaagagccacacctagggtattgatagattcaacagcggttactaaatcgcgagatcctgactgcttcaggagggtgtattgcttccttgacgatcctatgggctcatgttccgcacaaaaaccagacgcggagaggagctttcagccgttaaggctcattttgacccttcagcatcagacgccccagagcgattcctctggaaccaggaggcggatggtaatacaataatacccgacgcgcccgagagattccgctttcgccttcagcactcgcgcccctctctcataggtgcaccgacccacatttaccctcgtgcacgccacggtcggttcccgcacgatatatgctcttgttgagatatcatacatctcaaacggcttcaaacggctgcgttattatgcagcagctgctgttagaaaaagcgaaaataataccgcatggaggttgtccagggagggggctttttaggtgtgaaattggccctaagtgggacagccggcggcagccagcacctgggtgctgatgcccttagcaggcttcggccgtccggcgtacggttaacaaccaacttagcactggtacggacaaggggaatctgactgttcgccttcagcactcgcgcccctctctcataggtgcaccgacccacatttaccctcgtgcacgccacggtcggttcccgggccactttccgtggagatccgatggatcccagcccacaaggggatagatggcaatgaactggctgattgcgcggctaaagaagccacgggatcgcccatagcgccagcaggtgcaatagtaacatttcgtgaagtttcggcatttcccagctctgcgggatagagagtttttctcgactccacagaagtagacgtgggttttccgctagatgcgatctaactggtggtggtagtttgcggttaaagtagatagagaagactgaagccttgcgagccttccttcgcgatgagaaccgccgtaagtggctacaacgcaaaagaccgcttcttcttccagagcatgcagctaagcgtcttgcctgggcggaacagtataaggatattgactggaactgtgttatctggagcgatgaataagaaaccaacagggattgccctagtaacggcgagtgaagcggcaacagctcaaatttgaaatctggcgcaagcccgagctgtaatttgtagaggatgtttctggcgacgtgccttccgagttccctggaacgggacgccatagagggtgagagccccgaagaaaccaacagggattgccctagtaacggcgagtgaagcggcaacagctcaaatttgaaatctggcgcaagcccgaggtgtaatttgtagaggatgtttctggcgacgtgccttccgagttccctggaacgggacgccatagagggtgagagccccgaaccagaagttggacgtaaatccagccccgcttcattgaataagtaaaaaaacaataggagtagtggtatttcaccggcaccgagagacaatgctttgccggagatcgtataggtcggccaatgggcagtcagaatttagttggttgaccaccgtacatttaggctggatgagagatggacaacttcacttactccaatagcacggcattgattggacactattgagtcaaaatctatttttgctccttctccggggtcgagccctaaccctccgttacccgttgcaaccatgtttggccaatacccaaacatcgaaagttgactccttctccggggtcgagccctaaccctccgttacccgttgcaaccatgtttggccaatacccaaacatcgaaagttgctagggaagaaatttgaatgaaccgagcgtacgaagggtcgggtcaactccccaagggtccctttgcgagcaactacgcctcttaaggtgctgaaagagggtatttctcgtaggaaacagctgactgcaagagccacaggtccgacggttacggtcatatctgtaggcctcttccatccggcaagagggattggatcaccgggttattaagggaccttggcgggcattggcgtggggcttccttcttgagaccgctctcacgaacaccttcttactgcagaagcatggccagccaaattggaagccgttccggaccttacacgagtgcttcagaagcaatcttcgtaggagcaatcctcgcagaaggattaccgggctatggggtctatccctgtgaaaggggattgctgcagtagatattatgagaccctcatgcccctagggcgtggtgttggggatcggccaaagcccgcgagggacggccggcccctaaatctagtggcggacccgcccaaagcccaacgtacccaacccttagagccaatccttatcccgaagttacggatctattttgccgacttcccttatctcatgctcagtccaacaagatatcttcaaacagcactggccatatatggagatgttaaagaatttcaaaagggccaacgctacaaagtcgggagatatagagagatccaaagagagaccgtcggagagaatcagcttctggacgatgctggcaatttggcctctagaattaccacggttatccaagtagtaaggtactatcaaataaacgataacttatataatgagccattcgcagtttgacctgtaactggccgggtgcttgcatgatcatggtgagagtgtctgggtgtgctatgtagtacctttccattttctggtcttttggatcttgtaattggaatgagtacaatttaaatcccttaacgaggaacaattggagggcaagtctggtgccagcatccgcggtaattccagctccaatagctgaacgcctctgagcaggagattggctacgccaaaggagatctctgtgtcacgatccccccgctttccatggcctcctctgcccacaaccgcctcgtctacaaggatctctctaaggttctgccatcatttgacaagttgcgagactcaggctttgcaccatctgcctttcccgatagtcttgttctgcgagagaggagatgtgcgggatgtaaagatagactggctaccctgcagccgcttcccgagagacagaccgggcgccagaactctgccgtccttgtagagcttcttacatatttaaagtttgagaatggatgaaggcaatatatagcccccgggtccctaatcattcgctttacctcagagcttcttacatatttaaagtttgagaatggatgaaggcaatatatagcccccgggtccctaatcattcgctttaccgcataaaactgagttcaatactgctatcctgagggaaacttcggcggaaaccagctactagaaggttcgattagtctttcaaataaatacctcaaggtaaaggagcatccaaatttattgttggcattaacactgtaaaaatatttgtcattttttttttctttttaatatagcgtactttctttaggggaatttataaggatggttggtttgattgttgttttttatttttgagacaagcatatgactactggcagaatcaaccaggtaactatcgttcgccggggttggccaccagcgcccacgaggtgcactgagttggcacagaatagacgccgcaaggaccgcaatcgaggcgataagggagctttttttggactccccaaagacgggctcgtctatctcgtaggccgcattgccgagatagatagtatttgctatcgatgccgccgcagcaataacgcaaattaggagcctaacctatactttacataacctatactcaacataacctacactttacataacctatactcaacataacctacactttaccctaacctatactttacataacctatactcaacataacctacactttacataacctatactcaacataacctacactttcgactgctttagtggtccaaagcagccaacatctaatggctgaagaagatgagaggagtggggaggcatacagactgtaataatcttctgctcttcgataggccacactttcatggtttgtattcacactgaaaatcaaaatcaaggggacttttacccttttgttctactggacctttacataacctatactcaacataacctacactttacataacctatactcaacataacctacactttacataacctgcaccctttacataacctatactcaacataacctacactttacataacctatactcaacataacctacactttacataacctgcccctcacatgacctacactttacataacctgcacctcacataacctgcaccccacaggctatctcaccgcctgtagctcactttacataacctatactcaacataacctacactttacataacctatactcaacataacctacactttacataacctgcgcctcacatgacacgtcgtccatatcggcgttgggcgtggtttgtgcgccaccctgtggacctgtctcaatctcatctagcatccggagagggagcatctcctgggccttcgcaaccgcctgaacatcctccacggaaagggtctgatattggcacaggggggcgtcttggataaattaaattgcaagatattaagccatttataatcttcatagcctctattgtcgttaccgatatgtaggttggatatgagtcgtgtggtcatcccaggtagatagagatgcctaaccccggtacgggtaacacacacattagctgtccctggacatactggctgtccctggacacattagctgacatactggctgtccctggacacattagctgtccctggacacattagctgtccctggacacattagctgtccctggacacactggctgtccctggacatactggctgtccctggacacattagctgtccctggacacactggctggcatcgagccacgggatcatagggatatctatattatctaggaatcgttagctaggagccaaaggcagggagagtgagatgaacctagtaatgtggtctttgtggccttgaagaagtgaagcctatcgtcgatgaatccgcccggtcggacagccgcaaaaaccaattatctgaatgagcggttcctctcgtactaagctcaattaccattgcggcgagggcccggtcggacagccgcaaaaaccaattatctgaatgagcggttcctctcgtactaagctcaattaccattgcggcgatgggaaaagaaaccaacagggattgccctagtaacggcgagtgaagcggcaacagctcaaatttgaactctggcgcaagcccgagttgtaatttgtagaggatgtttctggcgacgtgccttccgagttccctggaacgggacgccaaatacaccgtcccacatttaccctcttgcacgccacggtcagttcccgggccagttttgattttccgcaaaattcatttgtatgggaaatccgtggccatcaaggataagtaacctaggtctcttggtctcgggcttcgtcaacgggatgaagatcaggtcaagccatgcaagagcgatctcgtcattcgtccagcctgttgcagaagctgctaagtcagaatccatgccagaaagcggtgataccacccgcacgtacagatggacaagaataggcttcggcttagcgtcgtagcaggcgattactctacggtactagaagtgtgctgtagtatttcgcgtattgtaattttaaaacgagcggggtcaaactaagtcagaatccatgccagaaagcggtgataccacccgcacgtacagatggacaagaataggcttcggcttagcgtcctagcaggcgattactctacggtatcaaagattcgatgattcactgaattctgcaattcacattacttatcgcatttcgctgcgttcttcatcgatgccagaaccaagaaatgcctggaatagtgacaagggcgttgacggcagctgcataatgtgtggtttgcgaggagggccaattaggaagggtcgaaaacgcacaccgcgtatggctgacttccagttgcttatgtatactgttgtgggttgttttagtagggtaggtgccctgtaactggccgggtgcgtgcatgatcatggtgagagtgtctgggtgtgctatgtagtacctttccattttctggtcgaaaattccaaaaagtgacatgtaaactcggtaatgatccctccgctggttcaccaacggagaccttgttacgacttttacttcctctaaatgaccgagtaggtcatcttgctgattggcgatgaatcaattagaatatccttcttcgcaagctcctcgcgataggctctcttgaccggcgaaaagactgatatatcaagcggaggtcatcttgctgattggcgatgaatcaattagaatatccttcttcgcaagctcctcgcgataggctctcttgaccggtgaaaagactgatatatcaagcggctgtaatacgtgcgatgaatgcgaaggtaagaaaagaaggaatatatcattctggacgtggaggtcagtgacgaagcctagggcgtgagcccgggttgaacggcctctagtgcagatcttggtggtagtagcaaagacttcaatgagaacttgaaggaccgaagtggggaaaggttccatgtgaacagcggttggacgtgggttagtcgatcctacaatgcccttcggggctctctggtgattcatgataacttctcgaatcgcatggccttgcgccggcgatggttcattcaaatgatcattcgcccgggtttcgcctgtgccttccactgtgctactatcctcctcgtctggtcgagcccggccacctcaccatcgccgtcttccttgccgctgctcctcccgctcgagggatcattaccgagtttacaactcccacacccatgtgaacatacctactgttgcttcggcgggattgccccgggcgcctcgtgtgccccggatcaggcgcccgcctagtcttataaaagctatatatatcggtcgaaggttttggtggttgtgagttgattttttagatttcctatagtaatgaatgttgcttatgtatactgttgtgggttgttttagtagggtaggtgccctgtaactggccgggtgcttgcatgatcatggtgagggtgtctgggtgtgctatgtagtacctttccattttctggtcgaaaattccaaaaagtgacaaaccacgcccaataaagaagtcgcagaccctcagcatcatcgaccaactcttacgcggatccctgttgacgggggttccgaacctggaatttgttctaatcgatctgcgaaatgttgcagaagtgcacgtgaaggcggccgaggctggttcagcatatatatatcgtggcaggagcgtgatgatgtcgtctatagagagtccaaaccgaacgcgaggttaaggtgccagagtagacgctcatcagacaccacaaaaggtgttagtacatccagacagttggacgggatcttccggacctggtgactgcccttaggcgttgaaatatccggttcgtgatgatctttacgctttatcccggcctttagaggagttaagggaggagttgaaggtggccggaagggcccaaacaccggcttcatcacatacgggctcatcaagggtttggccacgttacctacactttacataacctgcacctcacataacctgcaccccacaggctatctcaccgcctgtagctcacgctcagtagggaattattccttcccgcggattttcaagggacgtcgagagcgcaccagacccagcagaggtgctgggctcttccggccatgaggggccacttgccaagatcctcttaaaggacctcatgtccatcttagtagctggtttgacttgaatgacctatgaataatcctagggatataaggtagaaatataacttgggctcctttcacagaagttggtctgaaaataacgcttatctagcccagataagggtctagaaaatccgggaaaaatcctaggatattctcagacgacctaacctatacccagcctaccctagactaggtcttagatcttgaataattccttcagctttaaagataagatatttaatatctatactcaattgctttggcagtacgctggcttcttagagggactatcggctcaagccgatggaagtttgaggcaataacaggtctgtggttgaagacattgtcaggtggggagtttggctggggcggcacatctgttaaaccataacgcaggtgtcctaaggggggctaccttcacccgcactggcctttgccgatgtcccccagcttgcctgtgggtcaacttgggtcgtagctgacatggcgggcggaaagcagcgaggaggtcaaccttggaaagttgggggtttaacggcaggggctcgtcgctctccgatgcggaatatcactacttcgcagagggcttaatctttgagacaagcatatgactactggcagaatcaaccaggtaactatcgttcgccggggttggccaccagcgcccgcttttgctgccacagcgcccgcaccaggatttcttgcgccagtggttccccccgacctgagaagagaaagggccgatacctccttcaagcgcactctccatcaccacccgacggtttcgactccgcaaattccccagactctttaccgagaattgcctcaaaagtcatgtatatcggtagcgcggtttggtggccgtgagtcgatttttttgatttcccatacaaatgaattttgcggaaaatcaaaagtggcccggggcacgcgcgaagatgtgagagcgtcaatacccatgtctgaacctgaagaggagacattgcttggcgtataatcacaaccgacttcatgcagctctcgtggtaagtttagccagcggccatccatccacagaacccatccagcgccggcgagagcagagctctccccagaccaggcctcctcagtacgacgtaccgcacgcggccgctttcgattagaacttaattaaaaactaattatatagattatattatatatagcctgatcttaggatattacctcttatatatagtaagcaccagcggcagggccaccgacgccgcgcacggcaatccaccttccccctctcagttccccagggcatccttccaccagccggcttccacggaattcctgatattagttactagtaaattgtatatgcgttcgaacaggctgggctgcgggcttcaacgctcgtggattatctcggtagttgacgataccttcctatcgcccgcgcgtctcacccatacctcgccctcagggtagaaacgatgccctgaggagtaggcggacgtggaggtcagtgacgaagccgagggcgtgagcccgggttgaacggcctctagtgcagatcttggtggtagtagcaaatacttcaatgagaacttgaaggaatagtaatttgtgtggggaaggttctgaccctcctacgcgtagcccgaagtcaccgtttgaggcttttaataaaagtggggaaatacatcgcagtataaactatagttttagaatataatatatatatataaattaaatctatataatataaactatatagagaatttaaactaaatactaaaaacaatacatttgtccaccgcgacttgaagataccacatacctagcgtatatcgctatctatataaaagggaacaaatactaaaaacaatacatttgtccaccgcgacttgaagataccacatacctagcgtatatcgctatctatataaaagtgaaagacattgctcgatccaatgcatcctctcattatcctctcaccctgcccgaggctgcgtggcggcggcagatttggttttagttcgccgggtatagggtagctggttgtggtttctgcctacccggtaccccaacttcaaaccggtctcccgccttccataaaaaatgcgacgaagagaagccgatctgccgcaggtgtagggaaggtggttggaagtgtgatggatacgcctatgtaactagcaccactgctggcagcgccatacttcctgggaacttcagcagtagaagcggcagcttcgatagcagtagaagacccaatagcacgtcttctaggagacttgccgtcagacagtcggcatcatcctgcgctaacgctaagagtatagccagaatacctatagcatccgtcgccagccttcttacatatttaaagtttgagaatggatgaaggcaatatatagcccccgggtccctaatcattcgctttacctcataaaactgagcccacaggctatctcaccgcctgtagctcacgctcagtagaccggccctccctgtatctagccactgtcctcgacttacagcgcccacaggctatctcaccgcctgtagctcacgctcagtagaccggccctccctgtatctagccactgtcctcgacttaccgcgcttcccaccctctaaaacaataatttaccgcggctcttaacaacttttttgattttacataccctgcagcgcccgcgtggtatttcaccggcgccgaagctcccacctattctacacctcctatgtcttttcacaatgtcaaactagagtcaagcgcaacagggtcttctttccccgctgatctggccaccttactcgcctgaccttaatccaattgagaacctatgggctcttatgaaggctgagatctatctactttatccagagtctgaccccacgcccaatgaagcctgccgcttgtatcatccttctttagctgtataagccggttgaagataccgctgttgatacggctgttgatacggcatgtaccggttgccccgatgttcaacgctcgtaggactgtaaatagatcagggcttgagaagaggttatccaagaagacgtgaggccgttcaacccgggctcacgccctaggcttcgtcactgacctccacgtccgcctactcctcagggcatcgtttctcccctgagggcgaggtatgggtgagacgcttgagcgccatccattttcagggctagtacattcggttggtgagttgttacgtactagccctgaaaatggatggcgctcaagcgtctcacccatacctcgccctcagggtagaaacgatgccctgaggagaaggcggacgtggaggtcagtgacgaagcctagggcgtgagcccgggtaggagtagtggtatttcaccggcgccgaagctcccacctattctacacctcctatgtcttttcacaatgtcaaactagcgtcaagctcaacagggtcttctttccccgctgattctgccaagcccgttcccttggctgtggtttcgctagatagtagaagcggggttatacacgctatggctgacttccagttgcttatgtatactgttgtgggttgttttagtagggtaggtgccctgtaactggttgaccggcgaaaagactgatatatcaagcggctgtaatacgtgcgatgaatgcgaaggtaagaaaagaaggaatatattattctggaagcatttgatcataaattcatcggttgtatgacttccgtggccatcaaggataagcaacctaggtctcttaagacattttttggaagcgaagcaaggaccttctcgagctagactttgatattttcaatcagccatgcatcgaatttattctcgcctttttcttcatgagtgtctacttacagagcacgacggaattgactggcgcttgttggaatttcgctgggttgtccaaatgaattttgcggaaaatcaaaactggcccgggaactgaccgtggcgtgcaagagggtaaatgtgggccggtgtatttccaaatgaattttgcggaaaatcaaaactggcccgggaactgaccgtggcgtgcaagagggtaaatgtgggccggtgtatgtctgaagagtacccaggctcatgggagggcgtcccgcgggcgctgcagggtatgtaaaatcaaaaaagttgttaagagcaggcaagacttatttgtacacgccacctttattgcgaggaggataggctatatcatttttgacctctgtgggttgttgccaattgtacttctaatgggtccgggtcgcgcgtgatccgtcgggagcatgcttttccccataccccatatacgaccttaataaagaaaccacaaccgctacattcctcaccggttcaacacattcctcgccgccaaacctgcgtgtgtgtgaccgaaggaaatatggatagacgatagaagagaagaagagcagagaagggaaggttttaaaccctgaagacatttaaggcggtccacctggaaaagacggctccaaacgccccagtctctttgctgaccaccctcgctggcacaagatcacacgccggctgacaaatcttttagtagcgtgaaaattcacccaccaaatttcaacggatcctactaggaaccgtcgtggcattaatgatagggtaagcagctctaacgaccgggcagcttgaccaccagataagtgaattgtaaataacagacattcaaggaattccgccggaaagctctccaaactcggtcatttagaggaagtaaaagtcgtaacaaggtctccgttggtgaaccagcggagggctcattaccgagtcaacgcaagctgatgacttgcgcttactagggattcctcgttgaagagcaataattgcaatgctctatccccagcacgactggcccgggaactgaccgtggcgtgcaagagggtaaatgtgggccggtgtatttctgaagagtacccaggctcatgggggggcgtcccgcgggcgctgcagggtatgtaaaatcaaaaaagttgttaagagccgcggtaaattattgttttagagggtcctacactttacataacctgcacctcacataacctgcaccccacaggctatctcaccgcctgtagctcacgctcagtagacccactcgccaagagatattcttgtgcttcatcgttctcgcgtgagatcctcttaaaaagctcacacctctgaggggacgacctgatgaacttgacaacattgtggagttttcccaccggcaaaaaagttgttaagagccgcggtaaattattgttttagagggtgggaagcgctgtaagtcgaggacagtggctagatagagggagggccggtctactgagcgtgagctacaggcggtgagatagcctgtggggtgcaggttatgtgaggtgcaggttagatcggccaaagcccgcgagggacggccggcccctaaatctagtggcggacccgtcgtggcctcctctgcgaagtagtgctattccgcatcggagagcgacgagcccctgccgttaaacccccaactttccaaggttgacctcagatcaggtaggaatagcgactgcggagcaaggtggcaaaccgtattgcatgtcctattacaatgccgaagataccagcgccttcgacgacaactgctggggccattcccaggaagtcttcggagaatagtcaacggacgcaaatcagccgtcaaagctatcaaattcatggaacatcatccaccaagtgaggacccgtctgcgcacccggcgcaccgccgactagaggagcaagatgcgacgatcatatctaaacttatgacgtctggtattgctcctcgagatatacagacctacgctcataagcatttggacaccctgattactcagcggggataacgaacgagaccttaacctgctaactagcccgtattgctttggcagtacgctggcttcttagagggactatcggccaggataatgagaggatgcattggatcgagcaatgtcttttgcgtgatttggtacagcatgcggtctttattgggcgtgggttgtcactttttggaattttcgaccagaaaatggaaaggtactacatagcacacccagacactctcaccatgatcatgcctcaacacggggaaactcaccaggtccagacacaatgaggattgacagattgagagctctttcttgattttgtgggtgggggtgcatggccgttcttagttggtggagtgatttgtctgcttaattgcgataacgaacgagaccttaacctgctaactatacttagacatgcatggcttaatctttgagacaagcatatgactactggcagaatcaaccaggtaactatcgttcgccggggtgggtcgtacggtattaggccagatccaataaagcctgcctggatattttcctctgtaaaggagtggaagaaagctgtacgaaaggaagagattttccgcaaaattcatttgtatgggaaatcaaaaaaatcgactcacggccaccaaaccgcgcgaccgatatacatgactcttcttgtacctcagtcgctccgtattgtcactatggcaatcattcttttattcctggtcaccaggtatgtatacatatggcattgaacaacagaccttttctttgggtgggtacacgctcgactaaatcctcctgccaaggctccgcctggcttgggcgggaggcccaattgatgccaacgcgctccgcgtcgcggtcgcgtaacagcaaattcgccatatcttgcacctcactccatcgaggagaaaatgcttgggaatccaggtcgagtatccgctggagaacaacttgttcctctaagattgtaagtttgcgagtgaaggagaaaagagagatgatagtcttaataaaacgcattttgaaaatcggaaagaaatatgatttaatatataaaagtaaaatggggttaagtaaattgatgatttagaatatttgatgattgatggtagaaaattaaaagcctgaatcaatggcagaagggaggccttcgttgtgcgtaccatgctgattcgtcggttagaagaacggagaaggatgttgaaaacaagaaagcaaaagacaggatgggtggcaaatcggcccccatgtcgctgcagcacgtacttggcccagtaactgagcgagtggtttggctggtgctaatcttctctgttcggagttgagtaagaatggagctttgtcgtttactcagctggtcatgaagttgcaggactttccttgtaggtttcttggtatggcggaaggttgttctccctctggtttccttttcccacccttcgggatcgaaattgtcttatattcattggaagagcgaaaggccaaccaagggcgaggagtcgatgtggcttctggacttggacactgcttcattcgagtggaggagagcttgaattatgccatatgtggcacacaacaaccagtacacgcggtgaggcggaccggccagccaggcccaaggttcaactacgagctttttaaccacaacaactttaatctacgctattggagctggaattaccgcggctgctggcaccagacttgccctccaattgttcctcgttaagggatttaaatagtgctgctccgatgccctccacctctgcaatcgtctgtgcgtagatgatcattcgcccgggtttcgcctgtgccttcccctgtgctactatcctcctcgtctggtcgagcccggccacctcaccatcgccgtcttccttgccgctgctcctcccgctcttttactttgaaaaaattagggtgctccaggcaggcctttgctcgaatacattagcatggaataataaaataggacgtgtggttctattttgttggtttcttggtgacgggtcttgctcagggccggcaagaagcaatgaatggcggtgataaagggagcctaggcaccgaaggagccgataggccgatatagaatcgatccaaggcaaacaaatatttctctgctagcttattcaagagctacccctcccgtcattcgggaagggccggtctctgtcctccgtaagtgcctgcggtggtgctgggcaggccgtacaataaagcgacagaccaagcagatgcagctgccggatctgtgatgttgaaagcggcttcgtcgccgcaagcaggccctcgactgaccgtagaataatatctataagtatatattaactataaatagaataattagatataactattactaatagtatagattatatataatagttttaacgagattcccactgtccctatctactatctagcgaaaccacagccaagggaacgggcttggcagaatcagcggggcaagaagaccatgcatgtctaagtataagcaattatacggcgaaactgcgaatggctcattatataagttatcgtttatttgatagtacattactacttggataaccgtgaatataattagcagtctatatctaaacctttaatactataagataaagttaaatattatactttcagcctgggtataggtattaataccttaaaaactctccccagcttgacgagacattcgtacagcgagagtgaatctgtacagattacgaggggtatttccggcagtgacagttttaaagtgatcatccggagcgtgctcgcgatcgtgacaccaacgtcgaagccggccaccatgccatagacttctgacgcgagaaagatgaaaagcactttgaaaagagggttaaaaagtacgtgaaattgttgaaagggaagcgttcatgaccagacttgggcaggtaaagatgaaaagcactttgaaaagagggttaaaaagtacgtgaaattgttgaaagggaagcgttcatgaccagacttggtcaggttgatcatccgtttcctccacacgtcgtcccgccatggtggacgggcccaaggacatttatcgaagagaatgccgagaaggcacaagcgagacaccagtacaatactgtaaacgagttaaacgctctgcatatatacacggacggaagcgctatcaacggccatgtgggagcggcagcagtatgtaccactatcgataaaaccagaagtgcttatatgggcaaggataccacatcgacagtgtatgctgcagagctacagggtatctctctggctctccagatcgctcaggagaacagaaacaggggcaatattgggaagaaaatactgatctacacagataaccaggcagctatcaggtcggtggcaaggcccagaggccagtcaggggcatagcagagcagaagggggtggacataagcatgctggcgtttacgcaaggatccagctgccgacgtcttctgctagacgaggggatggatgggtcagggccagggccatgcgaggcaggtgaggcagcgtgtgatgtatgtgccagggctaggcaggcaacagacaacccagcgaaattccaacaagcgccagtcaattccgtcgtgctctgtaagtagacactcatgaagaaaaaggcgacaataaattcgatgcatggctgattgaaaatatcaaagtctagctcgagaaggtcctgacgaaacttgacgcaaaaagcaagctagtgcaccataggtcggctgtctgtagaacactagcatccaccttattctgccttactaaatgaaggtcttccagcaacattcccattgcaaaatctgcactctgaaccctccgatcgcgcgtctcaaacagaggtgctggctgccgccggccggttgcccggctagtggctgcctgctcccgaggcgtcctcccaaagcccaacgtaccccacccttagagccaatccttatcccgaagttacggatctattttgccgacttcccttatctacattgttctatcaaccaggtatcgttgaattcaacagtaacgtcaggtgagtaaagatacccttcgttttcaaagatctgaccctcgggcttgccgtagaaaatgaccttcggtttcaaccgttggatcccatctgcgaagatgtaaaggatcaaggttgcctgcctcttattccacgcttaagttcagcgggtattcctacctgagctgaggtcaaccttggaaagttgggggtttaacggcaggggctcgtcgctctccgatgcggaatatcactacttcgcagcgttcgttatcgcaattaagcagacaaatcactccaccaactaagaacggccatgcaccaccacccacaaaatcaagaacgagctctcaatctgtcaatcctcattgtgtctggacctggtgagtttccccgtgttgagtcaaattaagccgcaggctcgccagatttcaaatttgagctgttgccgcttcactcgccgttactagggcaatccctgttggtttcttttcctccgcttcttgatatgcttaagttcagcgggtattcctacctgatctgaggtcaaccttggaaagttgggggtttaacggcaggggctcgacgtgtgaagctagaggtgccagaaaagttaccacagggataactggcttgtggcggccaagcgttcatagcgacgccgctttttggataaaagtgatgaggaagaggccgatgaggagaagtccggatttccagctgatgttgaggcgtcgttcctcggggacggcgcgcggctcggactcagggattgatgcttcacctgtggtgatggggagcgtgatatcttcgcggccgatggtgcttggctggtcggtagtcctgcggcaattcaacgaagtaatgcatcagatcgctctattgaagtcggaggtgcagatccttcgggaggagaatgagacgcttagtcgacgtcgacgtaacaaaaagaagcgtttaagacaaggaagaagtctaaccgtaggtcagggacaagatttacaaggccaaaatgatgttgacatgcagttacaagaagaaggtcgcgaaaatgggggtccatctgcgaagatgtaaaggatcaaggttgcctgcctcttattccacccacttcgatcggattttccttgtattgtctttgtgcctttgacctcgtacgtatagccatccagatattcaaaaggtataggcgtctcatcgatattgacgatacagccacagaattaatctaactattactaatatatataaactatagctataaatctaaattctagaattaattagaatttaataaactagatatactagctgctatatttataaaagaaatattatacttattatatactgaaataaaaatagaattagaatttctctagaaaagaataaaaaaatagggagatggccagctctgttcgaagggagataattgacttgaaccctgcaaccgctggatcatcaaggcgcttctcaatggccccaatgaagtttttgatggctctcgagaacgcttcagtcggctctgaatatgcaacgcatgctaagtcgatgcactttgcagcgacctcctcgatgtaaactcggtaatgatccctccgctggttcaccaacggagaccttgttacgacttttacttcctctaaatgaccgagcttggagagctttccggccctgagtggtggtttccctcctctgaagctgtgcgctgagcactcctcttggggcgcccaagccgcaccggccctagtggtcttggtgtggtggaaggatgccctggggagtaggcggacgtggaggtcagtgacgaagcctagggcgtgagcccgggttgaacggcctctagtgcagatcttggtgggagtagcaaatacttcaatgagaacttgaaggaccgaagtggggaaaggttccatgtgaacagcggttggacgtgggttactggtcgggaatatcctgcactggtcctccacgaagtgcaaacgcgtcacacgaagcagcctcgcgtcagaagtctatggcatggtggccggcttcgacgttggtatcctaagaagttaacttcttatatatagaaatagcttttctctagttctactaatagttttatatcttctagtttttttaaactaccaccaagatctgcactagaggccgttcaacccgggctcacgccctaggcttcgtcactgacctccacgtccgcctaaaagaaaccaacagggattgccctagtaacggcgagtgaagcggcaacagctcaaatttgaaatctggcgcaagcccgcgttgtaatttgtagaggatgtttctggcgacgtgccttccgagttccctggaacgggacgccatagagggtgagagcccctcgcattagcggacctcgtatccgctgtacgagaaccttacagcggttacgagcccgtattacagaaggcaacgtgttatcttcagggctcgctagaggtgccagaaaagttaccacagggataactggcttgtggcggccaagcgttcatagcgacgtcgctttttgatacttcgatgtcactgcgaacaccaacaccaccagagaccctgcctgagataaggcagccctgggttctaaagacaccacagactgcgtacgaggacaaatccaaccacagcgaatgcacgccactgtaaattccaccacagcgtgcatgcaccaccacaaatccaaccacagcagtactccctcctcttaattatagacacaaagacaacagagaggaagcgaatctatgctccaaagtctaagtactaagtctgtcagagccaattctactacactagcaaaaacggagcgcgctcgcgctgattgctgtgcccaattgactatatagaggattcttgatctagattcccaagcattttctccccgattacgcgaggtggcagatatggcgaacttactgctacgcaaccgcgacgcggagcgcgttggcatcaattgggcctctcgctttgtacagcgacagccactcctcaagacagttctatccagccatttcccggaccggtcaaagtcccttctggccaaattcggtttgcctgccaatatttgctacagtgttctaattaaaatgttagagcgcgtcgtaaaaaatgcgacgaagagaagataaactagataggtgggaagtagatgcagcttatataagagataaactctcaacgtcattaaatcccaaccgaaatgacctgaaacagttagttaagagcctgtttatagtaataaagctgcttttaatattatagatctagtagctatatctacttagtctattattttattatatagcttacctagtactattataggtacttatagagaatagagactagctagaagaaaagctatatcttaagaatagctatctacttatataggcctactgagtagtttttacaaataaataaaaactttcaacaacggatctcttggttctggcatcgatgaagaacgcagcgaaatgcgctgatacttttccggttagtgtgacggatcgcttccctgtcgcaattgcatagtccggcaggtcccagctttatgccgaccacgggtacaaacggaagaatctagctctcagaaatcacaaccagaggggagaaggacgtccctcagacccagtcgattcgcattcctcttttgtgacctcactgccgtagcatattttgtacggctaagatctcgctgcatttgaacacctgttgcggcactgaacaaagcgcccctgacgaagcggcctagcagctgtgccttcgagggactaaaggaagggtcagaaaagatgaccttttcaatcttattagctgaaataactactagaatactattatattctactctagttattagttctttagattttaatagtttaataatataattaaagaatattaattactataatgatcaacgaagtttcatatggatcaactatcttccgtgatattccatacgtatggaatactcgcaggctgtatggagtatggattaactgtattccatacaaagtattccatacgactaatccatacgccaaggcttagtatgcaagcaatgacctagaaggttctatagggccatacctgaatccgccatcagcgtcctctgccagcccccgaaagatggatgaacatacaatgtaccagctcgtccaatgggacagcatataatgggacagcccttccaatgggacagcatattatgtaccagcctctccagcggatcgcttccctgtcgcaattgcatagtccggcaggtcccagctttatgccggccacgggtacaaacggaagaatctggctcacagaaatcacaaccagaggggagaaggacgtccctcaaacccagtcgatggcggcggagtctccgagaggctcaacggccggagctagggtttactggccggaagagcccagcacctctgctgggtctggtgcgctctcgacgtcccttgaaaatccgcgggaaggaataattcggcttgtgagatgctcctcagagtcattgtccgaggccattgacagggctgatgaacatggagtttggcgcggagtaagacaatttgcctccggtgagttttaggtttgctctatcccctttcggtctggggtcggaattctgagcagaatttgggcgaagaggaagaagcgaggctttggagacaactggtcatgttggcataacatggcgaagtggggcgtcacggattaactgcggcgcttcggttgtttgccggacctcgttattgactgctgtatcgagaggttgaagaaggcttgtacaaccgggcgggatcagggctgttgtaatcttacgagatcgtaggtttgggagttgtaaactcggtaatgatccctccgctggttcaccaacggagaccttgttacgacttttacttcctctaaatgaggcatccaaccgtacggggctctcaccctctatggcgtcccgttccagggaactcggaaggcacgtcgccagaaacatcctcttccctactgtctcccaacatggaatataccaaattggattctagagtttgtttgtccgccaatgggactttctcggcattggatacgttcaaaagtaggtatcacgtttcgattggacaattctcgaagcatcaaggagctaggaatccaatatcgtccagtatcggaaagctttgggggcgaaagactaatcgaaccttctagtagctggtttccgccgaagtttccctcaggatagcagtattgaactcagttcttatatagctcgagttcaagaggaaaccactgctgttgaacccacttcccttggaagataataaggggaggaagagctacacctagggcattgatagattcaacagcggttactaaatcgcgagatcctgactgcttcaggagggtgtattgcttccttgacgatccttctcttcggctcctgtgagcggtgacgagtccgaccccttcgtgtaagtccagttcacaccggtaaccttagaaaaacacaaaaaaatgtaaaaataaaaaacacaaaaaaaacagatagcttagacaggtatatagatggggaattgaattgccccggtgacctcgccgcaatggtaattgagcttagtacgagaggaaccgctcattcagataattggtttttgcggctgtccgacggggcagtgccgcgaggagacaggctggtaagttagacactgaagtagaaatgagacaagttttctcgttaactaatcaaggtcgcagtctctcgtgtcttatacataatgcagccacccttcaagacacactattggtggcaggaatgcattatattatgagaacccgggatatatacgagatcgctaatacggtcgctacagcggccgttacagcggttgtgaccgctaatgcaattgccccaacgggcagctacagcgggttgggccggtggctccagaggacttccagctttggaaagccctaagttagttatttcattccttcttacccaagcggccgcgtgcggtacgtcgtactgaggatgcctggtctggggagagctctgctctcgccggcgctggatgggttcggccttctgaattagcatctcagcgatctttagatgccctcctgctgaagcagcgtgaagagcatggccataatgtccaccttgggcattgatatcagcgcccttctgaataagtatctgagcgatctctagatgtccttctgctgaagcagcctgaagagtggggaaatcgaggcgaaggacggcttaccctcagcagatcgtaacaacaaggctactctactgcttacaggaccgtttggcacagctaagtcgtccgagcgaatattcgtatctgttagaccgatcaatcgagcctttgtataacactgaaggaaggtcatcttgctgattggcgatgaatcaattagaatatccttcttcgcaagctcctcgcgatagaagccgtctagcctgtccaagtgaccactcagtgggaatctgcaagatacggtacagttgaagagatttcccacagcggctcggaccagcttgttacagttgacccgagacgctgtgagtggtttgctgcagcgccttaggctttcgccttcagcactcttttgattttccgcaaacttcatttgtatgggaaatcaaaaaaatcgactcacggccaccaaaccgcgcgaccgatatacatgacttttgaccctgttgagcttgactctagtttgacattgtgaaaagacataggaggtgtagaataggtgggagcttcggcgccggtgatgccatgagctcttcttttgtccattctctggatcctgttgaagtcacgcagcgctgagacatctgtttgtaatctaggcaccactcgtagcttctcttatcgtatctttgcggaagcttcatcgccttacgatattgctgattagtcttgatgctacccagtttgctagaacagctctagggtagctatgatgatggcgtgacccgggccacgattttcaactgcggagatggttaagctgctgtagggtaaggtaccttgatcacagtgcgccccgcagccaactcttgacgactagcggaggcacggcatatacatagttgcggaagcggcactaactgagcccgcaagagatataatataaataactatatataaatagatattagattaatattaaatctatattattcctaataaaaaccttctataatagtaagatgagaggagtggggaggcatacagactgtaataatcttctgctcttaacagtaggtctcaaagtcagctgagtggtggctcttatggctatcaaggattagcattcggaatacccccttcgtacgaggagctgtataggaattaaagtacttaatccaatccagacgccatgttcaggtggattgactcagatgtgacaccgttcgcgtatgacagattgctctctaatcttgcgtcgtttgccaatccagcagcagggggcactgaggccgagagcgggccgtttgcgagcctcagtgaggtagaagacgaactaacagagatcatcctgatgttctcggatggatttgagtaagagcatacggggccggacccgaaagaaggtgaactatgcctgtatagggtatcctgatgttctcggatggatttgagtaagagcatacggggccggacccgaaagaaggtgaactatgcctgtatagggggaagccagaggaaactctggtggaggctcgcagcggttctgacgtgcaaatcgatcgtcaaatatgggcatgggggcgaagtagacatgaggggacatgtgttgatggcgctatgcttgagcagtggatgagcatggtggtcgataataggtgtagttcggatgctatctaagatttagtaataaatactgtggagactgagggttttctcggtacctgtttccatagcctttataatgaggtagttatgttttaagtattgtagtagcaaccattctaaggtctacgcttgctagcgggaccttttctgctttactatttagtaacaaacatttttaaataatttaaagcttaaatttttatatatgttcatatatttttcttttaatatttttttttctctatttatattatataaagttatttttgctttattattagtatgtttaatttctacattacttataaatattcttcttaaaaatttacgagtctgtttacttctccccgacgcgtgccattccttcctaatcgacgcttagtccgatggaatctaacaacgtcatgctcccttccccagagtcatagttactcccgccgtttacccgcgcttggtcgaatggcttcgctttgacattcagagcactgggcagaaatcgctagtagctggtttccgccgaagtttccctcaggatagcagtattgaactcagttttatgaggtaaagcgaatgattagggacgccggtgtatttctgaagagtacccaggctcatgggagggcgtcccgcgggcgctgcagggtatgtaaaatcaaaaaaggtgttaagagccgcggtaaattattgttttagagggtgggaagcgctgtaagtcgaggacagtggctagatacagggagggactcggggaggtagtgacaataaatactgatacagggttcttttggatcttgtaattggaatgagtacaatttaaatcgcttaacgaggaacaattggagggcaagtctggtgccagcagccgcggtaattccagctccaatagactcggggaggtagtgacaataaatactgatacagggttcttttggatcttgtaattggaatgagtacaatttaaatcacttaacgaggaacaattggagggcaagtctggtgccagcagccgcggtaattccagcgactcggggaggtagtgacaataaatactgatacagggttcttttggatcttgtaattggaatgagtacaatttaaatctcttaacgaggaactccccctaaccctatactgctctaaaatactctctaaccctaaccctaagtaaccctaatatcccctccccctaactatttactgccttaaaatactctctaactctaattatatactgctctaaaatactctctaaccctaactatatactgctctaatttgtctgcttaattgcgataacgaacgagaccttaacctgctaactagcccgtattgctttggcagtacgctggcttcttagagggactatcggaagtatttgctactaccaccaagatctgcactagaggccgttcaacccgggctcacgccctaggcttcgtcactgacctccatacttccgatgctgatacggtccgccttcccagacgcgctcgtcgccacgaggatgccgtccattcttctagccaacccaattgccacctcggggtcgttgtcgtgccccaacaggcagacgccggtgccagggcgatagagtgtacgcgttgatcgtttccatccgctccaccgccgtggccttttgccggtttgctgcagcgccttaggctttcgccttcagcactcgcgcccctctctcataggtgcaccgacccacatttaccctccagcagatcgtaacaacaaggctactctactgcttacaggaccgtttcgcacagctaagtcgtctgcaaaggatttgacaccgctcgttttaaaattacaatagctgattcgtcggttagaagaacggagaaggatgttgaaaacaagaaagcaaaagacgggatgggtggcaaatcggcccgcatgtcgctgcagcacgtacttggcccagtaactgagcgagtggtttggctggtgctcagcagcctcctggatgggctgggcgttcagccattatccagcagatggtagcttcgcggcactgcccggtcggacagccgcaaaaaccaattatctgaatggcgtgcattcgctgtggttggatttgtggtggtgtgggtgcgctgtggttgattatgtagtgggttgggtgcgctgggggtggaattttagcggggtgatacacgctatggctgacttccagttgcttatgtatactgttgtgggttgttttagtagggggacagtcgggggcatcagtattcaattgtcagaggtgaaattcttggatttattgaagactaactactgcgaaagcattggacagtcgggggcatcagtattcaattgtcagaggtgaaattcttggatttattgaagactaactactgcgaaagcatgtgccaaggatgttttcattaatcaggaacgaaagttaggggatcgaagacgatcagataccgtcgtagtcttaaccataccaggctaccctataaccagcctaccctagactaggtcttagatcttggataattccttcagctttaaagataagatattcctcgtacgcagtctgtggtgtctttagaacccagggctgccttatctcaggcagggtctctggtggtgttggtgttcgtagtattatatctagctttgaaagaaccctctctgggtcgtacggcattaggccagatccaataaagcctgcctggaagctaggcttggccgagatatatacctttaggctagaccagctccccaaggccggttttcggccaggcctggtcaagatgcctcctagctagctatcttcatttaagctacttgaaatactgccagtatcagagctagatccggccggattcggtggtcagcaccgcctaagggcggtgagtttacgagcctgccaaaaaggtggggcgggcacgagtaacctgttgcgaagctgacaagaagtgaaagatcaaggatgactgtgtaagggtaatcaatatacatgtgtgctgacgatctctccttggtccgtgtttcaagacgggtcgttgatgaccattacgccagcatccttgcagagcgcgaacctcagtccaccccagggggtcatcttgctgattggtgatgaatcaattagaatatccttcttcgcaagctcctcgcgataggctctcttgaccggtaaaaaaactgatatatcaagcggctgtaatacgtgcgatgaatgcgaaggtaagaaaagaaggaatatatcgttttggaataatgattcacacgccgactgctatcagtatttttgtgtgcctgagtatggtacagctaatggccgtcttcatttccattcggtgcactttatgcggacacttcctacaggtagcgttgaccctaattttggtcgtcgggtacgccagaatactggcgggcgcaatgtgcgttcaaagattcgatgattcactgaattctgcaattcacattacttatcgcatttcgctactctacttgtgcgctatcggtctctggccggtatttagctttagaagacgtatacctcccatttagagcagcattccccaactactcgactcgtcgaaggagtttcacagaggctaggcatccaaccgtacggggctctcaccctctatggcgtcccgtcacgctccccatcaccacgcgtgaagcatcaatccctgagtccgagccgcgcgtcgtccccgaggaacgacgcctcaatatcagctggaaatccagacttctcctcatcggcctcttcctcatcacttttatcgtcgtcatggtcctgcgcggcgtcctgcccaaccgcccgctagcgttcacaatcgccgcctcgtgacgacaccgagccaggctgtccaattgacagaatgcccacctaaacctagacacggcgtcagaaactgagtggtcacttggacaggctagacggcttcggcttcgctggcgggtgattcatagtgggcgtcgaccctcacgaacgcggccgcgtgcggtacgtcgtactgaggatgcctggtctggggagagctctgctctcgccggcgctggatgggttctgactgagtggtcacttggacaggctagacggcttcggcttcgctggcgggtgattcatagtgggcgtcgaccctcacgaaggcggcccaatacgcgaaatactacagcacacttctagtaccgtagagtaatcgcctgctaagacgctaagccgaagcctattcttttccatctgtacgtgcgggtggtatcaccgctttctggcatggattctgacttagaggcgttcagccattatccagcagaatttgtatgggaaatcaaaaaaatcgactcacggccaccaaaccgcgcgaccgatatacatgactttttttgaagtggttgtcagaataatcagcttcgcgagctctttgaaatactggccttctcacttccctccgatccgcgtggaaggcgggagacatttgtatgggaaatcaaaaaaatcgactcacggccaccaaaccgcgcgaccgatatacatgactttttttgaagtggtcgtcaggcggctgtccgaccgggcagtgccgcgaagctaccatctgctggataatggctgaacgcctctaagtcagaatccatgcaagaaagcggtgataccacccgcacgtacagatggacaagaataggcttcggcttagcgtcttagcaggcgattactctagacgcgatgcggctcctgcgatttctagtgcatatggagcgaccactcacgctggcggaggctaaggaacttatagctacacagatcgaaaacgagccgcgagggtctgacgtcaagcgtcgactatatcgcgacgccgatgtgttggactactgccccggcttagtgacagttgttcacgccaccgacgcgatgcggctcctgcgatttctagtgcatatggagcgaccactcacgctggcggaggctaaggaacttatagctatacagatcgaaaacgagccgcgagggtttgacgtcaagcgtcgactatatcgcgacgccgatgtgttggactactgcccctctcaagccccgacctattcatcgttttgagggaaatgaaggttggggttacaggtacctaccgtacggacagcggaattcaaattactcacaaaccttaaaaaggctggtaataacggcaaattgaagtggagataggatcaaacagcaacagcgccaactgtaccgtatcttgcagattcccactgagtggtcacttggacaggctagacggcttcggcttcgctggcgggtgagtcatagtgggcgtcgaccctcacgaaagcggccgcgtgcggtacgtcgtactgaggatgcctggtctggggagtccttttatattatatcttttatatatatatattatttttctttttttagtatatatttaataaacttattattatatctaaatactattttatatattataaataaattatattctaatttttaatttattttatattttattttaagattttagaatatttctctaatttattattaattctttattattatattataattctaatctttagaatcttttagtattttttaaagagatagttattactatatattatagtaattatatattctaatagttcttttagcttattaagtttaaaaagctaatttttaactttattctttagtttattataaaatatagctttaagggaaatattatccttatctaattaaaatataattttcctaaatcttattatataatttaaaataacttctttttatttaaaattcttaagttcttttatagcttattatttatagtttattttactaaatataataataaaaataataataaaattattatagctaataaaaatattaataatcttttaattttatagtttagatttagctttatttttatactagctataaagatatatctaaaactagtattctatagtattagtaagataagtaagataagttcttataaatttaattttattcttttctttcttaagctttataaagaaaaacttaaagtatatttaaaactagattttaaatctattaaacttctaaatatttctattaaagagttctaataatataaattaaataattttactctagtttttctataatttactctttttaaggtttttaatataaagtataaactatttaataatctactaaataatagatacttttataatattattctattaaactagagtttctagagtaattataatatctttattattattatatagtaattaagataaaataattagctaaataagagttattaatatataataattagataatttatactctgtccctccggccgttgaacgagactcaatgtgtggactgcgatgtcactaacggagcgagattcaatatcgggtgttactttttcggcagtacagatcgcgtggcaagtagaatcggtacaacgtgacgcagttcgcgaggcaggcgaggattatagtaagttatagcgaacttccctgctgcgttatagcggtctcaaggcccaatacaccttgaaggccactgtaatttcaataggttatgagcccggctcactaacttacagcgctcttactgctatatccggctaattcccgctggaaagcctgtattttttgtaattggaatgagtacaatttaaatcccttaacgaggaacaattggagggcaagtctggtgccagcagccgcggtaattacccatgtgaacatacctactgttgcttcggcgggattgccccgggcgcctcgtgtgccccggatcaggcgcccgcctatgaaacttaattcttgttttattttggaatcttctgagtagtttttacaaataaataaaaactttcaacaacggatctctctggaaacggtccatagtgcaactggattgacctaacaagctggaataagaaaaggaggaggcttttccaactagatgtaaggcccttgtggatgaagaattccgagaggatgcacaaaggaggagtgttcaagagcgaagggatgagggtcacacagaagcccgcaacaataacgcgagttttgtgttgaggaacaggaagccttatactcggtaagtgatgaagtaggccagtgtatcgaagtcaagttatagatttagtattagtacagtgggagccatttagtatttgcccaccctcgtcatgttacaacgcgctgatgagccagatcaggttagatgtatccacaatcagattggagggctgtgatctgtcgggtctttgtgcctcatcgacgcaccctcaggttcgtgttgcgtgacatatgaggagccctatcattaatgccacgacggttcctagtaggatccgttgaaatttggtgggtgaattttcacgctactaaaaggtacgaagtgcacccgacggggactaccagttgtcccggcatttgttctgactgactataagtcccaatccaaaacgtttccccaggtactcttagagctgcggggaaatcgcatgaccaatggcgaaccctccaagtgcgattttaccagcctctacgtgcagttgtccaggtgcacgacgcttcgaggcatcaagcttctcagccctgtgcgggcccatgatttcctaggtaacaagctggaccaggctatggtcgatgcggtgcagagactcaaaagcctggctgcgaagacgagacgtctctatgaacattagtggcttcttcggattggcagctaattaatgatatgtacgagcctctcgcagatttagatatggaatctcttctgcctgaattcacaatgaactggtgccaagagaggctggaagagataggatttgacgcccggattgacctaccgtagagtaatcgcctgctaagacgctaagccgaagcctattcttgtccatctgtacgtgcgggtggtatcaccgcgttctggcatggattctgacttagaggcgttcagccattatccagcagatggtagcttcgcggcactgcccggtcggacaccaatactaacttcccaggcaaatcgagctcctggaacagcggatagcggagcttgagggagatcgcttccgaacaccaagggcggagtctgatggcgaccctcctccacacacacagccctgtgtgagctcacagagagccgctgagcccccggcactccctctatggcgtcccgttccagggaactcggcaggcacgtcgccagaaacatcctctacaaattacaactcgggcttgcgccagatttcaaatttgagctgttgccgcttcctcccgccgtttacccgcgcttggtcgaatggcttcgctttgacattcagagcactgggcagaaatcacattgcgtcaacgcataagctgcaaagaagctatcgcaaacctgctgccgccacgcccgttggtctgtataaggctgccaatttggctgcctacggagctgcaatagatagctgttcccaaggcaggtctcaagaaggaacttccacgctaatgcccgccaatttcccttataaacccggtgttgcaatccctctgagcataagctgcaaagaagctatcgcaaacctgctgccgccacgcccgttggtctgtataaggctgccaatttggctgcccatgtcctactcatagtgtacgcattatgaaaggcatgggggattgcgtcagctagtctcctcgagaagtggcatctaaccatcaggagatgggcgccatgcaccaccacccacaaaatcaagaaagagctctcaatctgtcaatcctcattgtgtctggacctggtgagtttccccggcgcacagcttcaaccatggcggtgtccgctgcacgtggcgatctcccgttgctcagtggtaagtttagccagcggccagccatccacagaacccatccagcgccggcgagagcagagctctccccagaccaggcatcctcagtacgacgtaccgcacgcctccgatgtctgggactcggaagcgttggatgcggtgcgataagacattttgatccgaggatgagtatctacagattcatcagctatatttgcttcttagatagaaggaacaagatggtattcagataattggtttttgcggctgtccgaccgggcagtgccgcgaagctaccatctgctggataatggctgaacgccgctaagtcagaatccatgccagaaagcggtgataccacccgcacgtacagatggacaagaataggcttcggcttagcgtcttacgtgggatatcgcccttttggtacgtgataatattgatcgcgagacggctaatgacaacagatacagttatagcgatatagtaagtatgcttccatattagtttaaattccactatatatagaaagacgaaaaatacgataagtggatatgagcccgcgagggacggccggcccctaaatctagtggcggacccgtcgtggcctcctctgcgaagtagtgatattccgcagcggagagcgacgagcccctgccgttaaacccccaactttccaaggttgacctcagatcaggtaggaatacccgctgaactctgtcaatcctcattgtgtctggacctggtgagtttccccgtgttgagtcaaattaagccgcaggctccacccctggttgtgcccattaaaacagatactgaagaaaataaacacctgtcctcgccctcattctatcactttatactctgctaggcaacagaggagataaccatttagccccgcacttcaagacctacgatctcgtaagattacaacagccctgatcccgcccggttgtacaagccttcttcaacctctcgatatagcagtcaataagccgttcaaacagtggctagccgaggcagctttcacctacgttgaacagcatgacccggatggaacggggccggtgtatttctgaagagtacccaggctcatgggagggcgtcccgcgggcgctgcagggtatgtaaaatcaaaaaagctattactattattcttatctattatattattatatagaataagtagattattagtagtagtaggagtatagtactactaagtttatagaactatagtagctataatatcttctttattattatatagtaattaagataaggtaattagctgaataagagttagccgtctagcctgtccaagtgaccactcagtgggaatctgcaagatacggtacagttgaagagatttcccacagcggagcggaccagcttgttacagttgacccgagccgtctagcctgtccaagtgaccactcagtgggaatctgcaagatacggtacagttgaagagatttcccacagcggaccggaccagattcgaatgctcacgttcaattaagcaacaagagcttcttacatatttaaagtttgagaatggatgaaggcaatatatagccccattcgaatgctcacgttcaattaagcaacaagagcttcttacatatttaaagtttgagaatggatgaaggcaatatataaagaataatcagcttcgcgagctctttgaaatactggccttctcacttccctccgatccgcgtggaaggcgggagaccgggttgaagttggggtaccgggtaggcagaaaccacaaccagctaccctatacccggcgaactcaaaccaaatctgccgccgagaataatcagcttcgcgagctctttgaaatactggccttctcacttccctccgatccgcgtggaaggcgggagaccggcttgaagttggggtaccgggtaggcagaaaccacaaccagctaccctatacccggcgaactcaaaccaaatctgccgccgacgtggaggtcagtgacgaagcctagggcgtgagcccgggttgaacggcctctagtgcagatcttggtggtagtagcaactacttcaatgagaacttgaaggaccgaagtggggaaaggttccatgtgaacagcggttggacgtaactgaacgcggagacgacggcgggggccccaggcagagttctcttttcttcttaacggtctatcaccctgaaatcggtgtgtccggagctagggtttaatggccggaagagcccagcacctctgctgggtctggtgcgctctcgacgtcccttgaaaactggaagtagaagtggcaaagccggcaaaccgatttgctggttgcgatgaacatattcccatcccaaaaatccgatggcttgacctttctcaccgtggtaagatagtcgtgcatatggacctctgttcattgttgcctcaacaacggcctcggacgcctgacgatatgaatagaggcgcccaagacaatgacggagttcgcaccatttgtaggcctggtcatgatcgtcctgcctggcacgacggtctgtgtgtgaatatgctttggtggcattcccagtgaggtgcatgtgctgaagtttggttcccggcgatgtgcatgtgctgtggagggtatgtaaagtataggttaggtggcgtgtgttgtgtgtgaatatgctttggtggcattcccagtgaggtgcatgtgctgacccatgcccatatttgacgatcgatttgcacgtcagaaccgctgcgagcctccaccagagtttcctctggcttcaccctctacaggcatagttcaccttctttcgggtccggccccgtatgctcttactcaaatccatccgagaacatcaggatcggtcttagtccttcgacgtgtgaagctagaggtgccagaaaagttaccacagggataactggcttgtggcggccaagcgttcagagcgacgaaagtgtaggttatgttgagtataggttatgtaaagtgtaggttatgttgagtataggttatgtaaagtataggttagggggcgtgtgttgtgtgtgaatatgctttggtggcattcccagtgaggtgcatgtgctgaagtttggttcccggcgatgtgcttccggccattaaaccctagctccggacaaaccgatttcagggtgatagaccgttaagaagaaaagagaactctgcctggggtagataaaagagtgaattggtggcttgaagaacctctatctagcagggaggaagccctgtacttataggtgtttcagagctctaagagccctgaagataacacgtttaatgcggatgcatattacccatatcagtaagcttgagtttctctcttcctttcgtacggctttcttccactcctttacaaagaagaatatccaggcaggctttattggatccggcctaatgccgtacgacccagagagggttctttcaaagctagatgagaactctgcctggggcccccgccgtcgtctccgcgttcagttgcgttgccgcgcaaaacccacatccaggtgccggactattgaccggcttccctttcgccacacggcgcaaagtgcgcctttgaaacggaacttccctatggcttaggatcgactatgagtgcctcgagattgtgcttccatatctggtgttttatcggcaggaggtgtgtctcgacgtctagtgccgggcccgaggttgctctgaacgcccctgatattcgttatcgcaattaagcagacaaatcactccaccaactaagaacggccatgcaccaccacccacaaaatcaagaaagagctcaactttctaataattctattctatttaattctcttctatttaataatactaattaaaatagatatttatttaatttaaagagctattttaatctaaattaacttaagctagtatattatctactagtactatatatagtatattagattataataattattaagtactagaggaagtggtaagtttagccagcggccatccatccacagaacccatccagcgccggcgagagcagagctctccccagaccaggcatccgggttagggctcgaccccggagaaggagcctgagaaacggctactacatccaaggaaggcagcaggcgcgcaaattacccaatccgtaacttcgggataaggattggctctaagggttgggtacgttgggctttgggaggacgcctcgggagcaggcagcgactagccgggcaaccggccggcggcagccagcacctgggtgctgatgcccttagcaggcttcggccgtccggcgtacggggttgaagacattgtcaggtggggagtttggctggggcggcacatctgttaaaccataacgcaggtgtcctaaggggggatcatggagaacagaaatctccagtagaacaaaagggtaaaagtccccttgattttgattttcagtgtgaatacaaaccacttcattgataacctatttacctctgctgacctctgccgtgctctgcgagagagaggtcacggaacaacaggcacatgccgccgcaactgtggcatttttgaggtatggccctatagaaccttctaggtcattgcttgcatactaagccttggtgcaatatatgcatatactgcaagtatgtactatatatacaagcgaatatacctatatagctatttttgcttccattttaataataatagttataccagctcctctatatttccgaacttaaagaaccgccatggttgaagctgtgcgctgagcactcctcttggggcgcccaagccgcaccggccctagtggtcttggtgtggtaccgccatggttgaagctgtgcgctgagcactcctcttggggcgcccaagccgcaccggccctagtggtcttggtgtgggggaaggatgccctggggaactgagagggggaaggtggattgccgtgcgcggcgtcggtggccctgccgctggtgctgtgtggtaattctagagctaatacatgcttaaaatcccgacttcggaagggatgtatttattagattaaaaaccaatgccctgcggggctctctggtgattcatgataacttctcgaatcgcatggccttgcgccggcgatggttcattcaaatttcttccctaggatcctcgctgccttcagcctcatcataaacacgaccacactcgcgaccacactcgcaaccacactcgcgaccacactcgcaaccacactcgcgaccacattcgcaaccgaactcgcaaccacactcacaaccacactcaactttgtgaaacaaaacagttgaatcataggtttgggcatctccagttgccaaggtatagtgtaatccggccactattaaagtgtcttggagggcacctgaggtctgaatgatggatgggaggctacaagcccagttaacataagatggatagctagtcttatacataatgcagccacccttcaagacacactattggtggcaggaatgcattatattatgagaacccgggatattaagacattcgattcgacctttctatttcataaaatcgaaataatccaacaaatcaatgagatgcttacgaatcagcataacgtcgctttttgatccttcgatgtcggctcttcctatcataccgaagcagaattcggtaagcgttggattgttcaccccctaatagggaacgtgagctgggtttagaccgtcgtgagacaggttagttttaccctactgatgacctcgccgcaatggttaaaggatattctcaatcgtcaacctctcaacacgccgtcgccagctcacgaaccctcctcttctgagataactacgcccacaacttatcgccaactcaataagtcagctaataagattgaaaaggtcatcttttctgacccttcctttagtccctcgatggtggaagcgggttatcttctcagatgagaccacagttgcgcgtggtcagggagagagacagaagtgggtgttctgcccaattgtaggtcaacttcaaccctgaataacttcatatcgactccttcgaggctaagctcaccagcaatatcagcacatgacttctcacggccgtaacgatcagtgcgtacttttgaaaggatcgctttagcagcttctggcgaggctacaggtggtctgccggagcgagcagcatcctcaaagtaggagtcttggcgtgcaagagggtaaatgtgggccggtgtatttctgaagagtacccaggctcatgggagggcgtcccgcgggcgctggagggtatgtaaaagggcatagggttccacagcgggaaaggcccggccggaccagtacacgcggtgaggcggaccggccagccaggcccaaggttcaactacgagctttttaggctacttttgattttccgcaaaattcattactataggaaatctaaaaaatcaactcacaaccactaaaaccttcgaccaatatatatagcttttataagacccacttttatctaaaagagactcttaagctgatcagttgagtatagatattgaatattctgcaaggatgctggcgtaatggtcatcaacgacccgtcttgaaacacggaccaaggagtcgtcttcgtatgcgagtgtaggccagacggcagcagtccaagcaccggcggggaacgcagcagcggatcagacagcggcagcaaaggaagtggcagaccatatagcgacagaccagtcaatggcagtccaagaattagtagagtacatagtggtcgaccagacactagcagtccacacagcgacaggacagacattgtcagcccagtcagcggtggcagagacaagtgcagcagcatcagcaccggcaccagcgccagcacaactattaaaagcttatattttatatctatttatactataagtaattattaaaacttagagataaatattattcctctatctttttgattttacataccctgcagcgcccgcgggacgccctcccatgagcctgggtactcttcagaaatacaccggcccccatcccatccagcgccggcgagagcagagctctccccagaccaggcatcctcagtacgacgtaccgcacgcggccgctttcgtggcacagcctctttgccgtaggcttcctttatgaccgtattctctgaggagatcgcgagaaatctgctcccgccactcgtgcaaggtccggaacggcttccaatttggctggccatgcttctgaagtaaaaagctattgcaaagagcgatcagagcactgggcagaaatcacattgcgtcaacaccactttctggccatcgcaatgctatgttttaattagacagtcagcttccccttgtccgtaccagttctaagttggttgttaaccgtacgccggacggccgaagcctgctaagggcatcagcaccaaatcaaaaaaatcgactcacggccaccaaaccgcgcgaccgatatacatgacttttgtaaacccgccatcccatctctgctaagctaccctgaaggctatatcgcctaagatactggagaaggagatgtgcgggatgtaaagatagactggctaccctcggttgaataagaagtctttgagaccaatcttctctgttcggagttgggtaagaatggagctttgtcgtttactcagctggtcgaagttgcaggactttccttgtaggtttcttggtatggcggaaggttgttctccctctggtttccttttcccacccttcaccacagcgaatgcacgccactgtaaattccaccacagcgtgcatgcaccaccacaaatccaaccacagcacatgcacaccgccgggaaccaaacttcagcacatgcacctcactgggaatgccaccaaagcatattcacacacaacacacgccacctaaccacagcgaatgcacgccactgtaaattccaccacagcgtgcatgcaccaccacaaatccaaccacagcacatgcacagcgccgggaaccaaacttcagcacatgcacctcactgggaatgccaccaaagcatattcacacacaacacacgccacctaaaacaggacttttactttgaaaaaattagagtgctccaggcaggcctttgctcgaatacattagcatggaataataaaagaggacgtgtggttctattttgttggtttctaggaccgccgtaatgattaatagggacagtcgggggcatcagtattcaaacttcgcagaggaggccacgacgggtccgccactagatttaggggccggccgtccctcgcgggctttggccgatccccaccaccacgccctaggggcatgagggttgaaatgacgctcagacaggcatgcccgccagaatactggcgggcgcaatgtgcctggagcaaactcaagctctggatgaagtagatagatctcagccttcataagagcccataggttctcaattggattaaggtcaggcgagtaaggtggccagatccttcaatgagaacttgaaggaccgaagtggggaacggttccatgtgaacagcggttggacgtgggttagtcgatcctaagccatagggaagttccgtttcaaaggcgcactttgccaaggtgaacagcctctggttgatagaacaatgtagataagggaagtcggcaaaatagatccgtaacttcgggataaggctccaaggtgaacagcctctggttgatagaacaatgtagataagggaagtcggcaaaatagatccgtaacttcgggatacggcgagacgctgtgagtggtttgctgcagcgccttaggctttcgccttcagcactcgcgcccctctctcataggtgcaccgccccacatttaccctcgtgcacgccacggtcggttcccgggccacttttgattttccgcaaaattcatttgtatgggaaaacatatctggcagagccaggggccgagccggatcgccagtctggtgttcgtgacgcccgagtcagcgatcacgaagggggtccaggacttcatccggcggctacaggcacggcagctgctggaccgggtggttatggacgagtgccacgtggttctggagccagcatattgttgatctatattcagctatgttgcctgatattgttggtccaggggatatctttatgcatgataatgccccttctcatacagcctagggggtttaacggcaggggctcgtcgctctccgatgcggaatatcactacttcgcagaggaggccacgacgggtccgccgctagatttaggggccggccgtccctcgcggcttcctttgcgcctcaaccttccgtaatgcctcgtgagatacccagcctcgtataatgctgtatagactccctgagagttcgataggcgtccggacttgctgcttcgcttactttagcccatccggaatgtgagtgtcggcttgtacaatggagagtgaagtagtcagaaccctggtttacagcggtttagttggcaactagcaactgtaaagcaggtatctcgtagttagggttcgtaaagtcatctattgacctctgagcctccttccaacaatgcttctgggaccaacaatgcttctgggaccaacaatgcttctgggaccaacaatgcttctgggaccaacaatgcttctgggaccaacaatagactaggtcttagatcttggataattccttcagctttaaagataagatatccaatatctatactcaactgatcagcttaagagcctctttcagataaaggcgtgtgttgtgtgtgaatatgctttggtggcattcccagtgaggtgcatgtgctgaagtttggttcccggcgatgtgctgccgccgcaactgtggcatttttgagccttttatccgggctaaggtagatgatacagctggtaagaacctgtggcattggggtgctggcgtaatggtcatcaacgacccgtcttgaaacacggaccaaggagtcgtcttcgtatgcgagtgttcgggtgtcagcaaggggctgttcgtcagatgttttgggctgccttcagtcatcagaggcgttccgggctgatagctcttaacggccggatcaatggccagcatattgttgatctatattcagctatattgcctgatattgttagtccaggggatatctttatgcatgataatgcgagatgggatggcgggtttacaaaagtcatgtatatcggtcgcgcggtttggtggccgtgagtcgatttttttgatttcacatacaaatgaattttgcggcgacgagtcgagtagtttgggaatgctgctctaaatgggaggtatacgtcttctaaagctaaataccggccagagaccgacgacgagtcgagtagtttgggaatgctgctctaaatgggaggtatacgtcttctaaagctaaataccggccagagaccggtagcgcaccgctgttcacatggaacctttccccacttcggtccttcaagttctcattgaagtatttgctactaccaccaagatctgcacttactgacgagcgaacttatcaaggagtgcatcgccttcttcttcgacaacctatacccccagctaccgatcctcgaccgtaactctgtggaacagcagttcttttgtatcttgtaattggaatgagtacaatttaaatcccttaacgaggaacaattggagggcaagtctggtgccagcagccgcgaggttgcgaggcgtggctacgccggatggtcttgtgagagctatccctacttattttactagtaatccccttactaattgagtcccgggctgaagccgtctagcctgtccaagtgaccactcagtgggaatctgcaagatacggtacagttgaagagatttcccacagcggcgaacgcgaggttaaggtgccagagtagacgctcatcagacaccacaaaaggtgttagtacatccagacagttggacgggggccatggaagtcggaatccgctaaggactgtgtaacaactcaccaaccgaatgtactagccctgaaaatggatggcgctagccaagacgttcaggctgatggagtcgagatattcgtagcctttacgtactttgacagcttcttcaacaagaagttggctcgaaacgatcgttgctccagggaacaaatcgaggttgtaaggatcaccagcaggcatgttcatgccaggctggaccacttttatctgaaagaggctcttaagctgatcagttgagtatagatattgaatatcttatctttaaagctgaaggaactattcaagatctaagacctccatgtgtccttgcgttggaactaaggcagggtaaccttttctgacgcgagcgccaacctctggtttccaataagtgtcccatagctccaattccgacctattttcctccataagagcggtagtcaacctttcaggtccatagaaggactcgttgatagaacgaaactggtccaccgctcccatatcaccttcaggaacggcctgcgcgccataacacctctgaaccgcaaccgatggatccaaaatatggaggccgtcgtggattgggcgcgctttaatgggaggcatatctccgtcttcgtgtctacacataggtggcgaacctgtggcgcaaggatgccatctgtgatccttacagaccgctgtctcgcctgcatgaatgcagtatctcattgcttcccggctgcggtgtcgcttctatgcctttggcatgccaacaaggcagttctacgttaaagtataagcttaaataattaatatttaaaaagagattctaatagttattactaataactattattatatatataaggatctagttattacaacttttgatgggtctttggcggtagatcgagtcgatctgtcattaaccccttgttgtaattttacaactgtaacatcattgatcttatgacgtcttttgatgggtctttggcggtcgatctacaacttttgatgggtctttggcggtagatcgagtcgatctgtcattaaccccttgttgtaattttacaactgtaacatgattgatcttatgacgtcttttgatgggtctttggcggtcgatctgtgattgaccttcttgttatggtttcgaaactggacggcgcatctccgaccgatcctgatgttctcggatggatttgagtaagagcatacggggccggacccgaaagaaggtgaactactgatcacggcaccgagacccctttgtgggcagcagcccaagccacccttgcgaagattgggcctaggaagctcaaattcatcgagccattatccagcagatggtagcttcgcggcactgcccggtcggacagccgcaaaaaccaattatctgaatgagcggtgcctctcgtactaagctcaattaccattgcggcgaggtcatcagtagggtaaaactaacctgtctcacgacggtctaaacgcttcgctttgacattcagagcactgggcagaaatcacattgcgtcaacaccactttctggccatcgcaatgctatgttgtaattagacagtcagattccccttgtccgtaccagttctaagttggttgttaaccgtacgccggacggccgaagcctgcggcaggagctttcagatgcccttagcaaaatccatctggggttcgacctatagacttcacccaatcggcacgctgttatggcggttacagctcattttcttgaccgcgtaggcaagcaccagtcgcgtctactagcacttcgacgccagctcgggtccttaacctcgcgttcggttcatcccgcatcgccagttctgcttaccaaaaatggcccactagtattgatacattcgaatgcagaaaccaacagggattgccctagtaacggcgagtgaagcggcaacagctcaaatttgaaatctggcgcaagcccgagtggtaatttgtagaggatgtttctggcgacgtgccttccgagttccctggaacgggacgccatagagggtgagagccccgtccggcccgtcgaagcaattcactattctggatgaaagggtcaatctcaattaaccggaataaatgccttttatccctcttattgaggctatgtggccgcgggagtatggatggggttgatttgtccgggttttacgtggcataaggctaggagttcgctacctttgcctttctagttgggtggacgttttaagcgaagttttggctgtcgttgagttgacaatgggtcccgtctacttgaggtgggccaactattgagaataagagtttagggccgccaaattgagcatcttatgaaggcacggattacctatattacaaaggaagatttcttccctgcatttctagaagcatttaatacctctataacccaggaaaatatccaggggggttttagaggagctggactttggcaaggtaatatagataaatgcaagattctgtttctgtttatacttgctatgttctaaactcttattctcaatagttggcccacctcaagtagacgggacccattgtcaactcaacgacagagtttattttagtttaatctaaaattatacttatttgggaataagaaaagttagttatataaggttattagttaattcgcttctataagtatagtatatatttactactatagaaggtttttattaggaataatacagatttacgaggaggatagtagcacagtggaaggcacaggcgaaacccgggcgaatgatcatctacgcacagacgattgcagaggtggagggcatcggagcagcactacgaggaggatagtagcacagtggaaggcacaggcgaaacccgggcgaatgatcatctacgcacagacgattgcagagggggagggcatcggagcagcacttggatgtgagatgttccacagcaagatagggacacaggaggctaaggtggtacagctgatttgtggtggtgtgggtgcgctgttgttgattatgtagtgggttgggtgcgctggggttggaattttagcggggtgatacacgctatggctgacttccagttgcgtgcttacagaactgagctgatcaaggatgtagcgggtgtcagggcatggcgctaggcagacgggtgcagctgtcgtatttaggtaaccaatagctgaagcacgtcgcttggacgtttgagaggattttcggactctaccgacaagttctatgtcagccttgtcatgaagcaagcgcctgggattgccgctgccagaggttggccgaaaaagtatattgatcagtatgtgatacgatactgcagtctgccgtatgcaatcccgacagtgatagaccatgcatggcttaatctttgagacaagcatatgactactggcagaatcaaccaggtaactatcgttcgccggggttggccacctagtttttacaaataaataaaaactttcaacaacggatctcttggttctggcatcgatgaagaacgcagcgaaatgcgagaagtaatgtgaattgcagaattcagtgaatcatcgaatctttgaacgcacattgcgcccgccagtattctggcgggcatgagacttcgacgaggagctcctagaggcccgcgatctctacgtccgccagcgtaaccctcctcctcgcccggctcctatccctattccccgtcctcgacctggaccggttcctcctactcctcctccctctcctgccatatctacattcttttacgtaaggtggaagctacatatcggtaccttgatgtcggatgtcaagtctatgcataagaagtttctgaatatctgactgcatcgccgttcgactcattcattcatccctttctcggtaaaaagtccgcatgatagtgcactaaacaacacaatagtctactcgctacattccctagcttgattaatgctacagctacgtgactatcttgtctactactgatttccttgaaagttgaaaaactgcaaaacaacacaatagtctactcgctacattccctagcttgattaatgctacagctacgtgactatcttgtctactactgattccttgaaagttgaaaaactgcaaatggtcagtacaggtggtcttggcaatacttcaaactacctttgttattctaattcttagtatgctaggagaggtttatcttgatatggattctggcgcccggtctgtctctcgggaagcggctgcagggtagccagtctatctttacatcccgcacatctccttctccggtatcttaggcgatatagccttcagggtagcttagaagagatgggatggcgggtttacaaaagtcatgtatatcggtcgctctgcctggggcccccgccgtcgtctccgcgttcagttgcgttgccgcgcaaaacccacatccaggtgccggaatatttaccggcttccctttcgccacaccccgggctcacgccctaggcttcgtcactgacctccacgtccgcctactcctcagggcatcgtttctaccctgagggcggggtatgggtgagacgcttgagcgccatccattttcagggctagtacattcggttggtgagttgttacacagtccttagccccgggctcacgccctaggcttcgtcactgacctccacgtccgcctactcctcagggcatcgtttctaccctgagggcgcggtatgggtgagacgcttgagcgccatccattttcagggctagtacattcggttggtgagttgttacacagtccttagcacaaatgaattttgcggaaaatcaaaagtggcccgggaaccgaccgtggcgtgcacgagggtaaatgtgggtcggtgcaactatacaaatgaattttgcggaaaatcaaaagtggcccgggaaccgaccgtggcgtgcacgagggtaaatgtgggtcggtgcagctatgagagaggggcgcgagtgctgaaggcgaaagcctaaggcgctgcagcaaaccactcacagcgtctcgggtcaactcctggagcccaagcactttgatttctcgtaaggtgccgaacgagtcaatttttaacatcgtccgatccctagtcggcatagttacggagggttagggctcgaccccggagaaggagcctgagaaacggctactacatccaaggaaggcagcaggcgcgcaaagtacccaatcccgactcggggaggtagtgacaataaatactgatacagggttcttttggatcttgtaattggaatgagtaaatactacagcacacttctagtaccgtagagtaatcgcctgctaagacgctaagccgaagcctattcttgtccatctgtccgggggcctctctcttttctgttatatcggggttggggggttgggggcctctctcttttctgttatatcggggttgggggggtgggggcctctctcttttctgttatatcggggtcatgggttgacaccatcgcacttcaccttgcgacgatggcaagcatcgcaggcacgcttcacggcctgcatcattgtggagcgttctgtccctccggccgttgaacgagactcaatgtgtggactgcgatgtcactaacggagcgagattcaatatcggacatcgtccgatccctagtcggcatagtttatggttaagactacgacggtatctgatcgtcttcgatcccctaactttcgacatcgtccgatccctagtcggcatagtttatggttaagactacgacggtatctgatcgtcttcgatcccctaactttctttcctgattaatgaaaacatccttggcaaatgctttcgcagtagttagtcttcaataaatccaagaatttcacctctgatagaggtagctcttaaaaattaattatttaagctttatattatttttagttatatttagatcagggtattagttttattagatgcacggcgtcggatgactacaacacgacgtacaggttgccaattctcagtgcttgcaaaggaggcattggataagactgttggtgtcgccaccaacagcttccagattcacaggtaaaagggataaattgagactgttgcttctaactagtaatcatcaaacccatacgatagcgaaatatgtgcaacaagaatgtagatttaaaagcaggaaataacggaggtcggttgatgatgacgggatgtttactaactagtagacacagtttttgagagagatatgtcgtttgttagtctgccaaacgaattacttctctatatagcagagaatctggaattagagagagatattaatagcttaggcccactagtattgatacattcgaatgctcacgttcaattaagcaacaagagcttcttacatatttaaagtttgagaatggcccactagtattgatacattcgaatgctcacgttcaattaagcaacaagagcttcttacatatttaaagtttgagaattgatgaaggcaatatatagcaaggccacgacgcaatggagaaagacggagagcgccaacggcgtccatctcgaaggagtcgccagcgataaccggaggagttgaaatggtaataagacgaccaatctgaccagcaaggaagccaagatgggaaaggtcatgcggcatacgctcggcgttatccaagtagtaaggtactatcaaataaacgataacttatataatgagccattcgcagtttcgccgtataattgcttctacttagacatgcatggcttaatctttgagacaagcatatgactactggcagaatcaaccaggtaactatcgttcgccgcgtcatcgtagagaggcgtccgttgaagattggactttgtgtgggacatggagagacgaagaagcagaaaggaggcattcgagaggcgtgtgttgaagagttctttgtgtgagaaaatggattagaaggaacgaaagttaggggatcgaagacgatcagataccgtcgtagtcttaaccataaactatgccgactagggatcggaggatgttaaaaattgagcaggtctccaaggtgaacagcctctggttgatagaacaatgtagataagggaagtcggcaaaatagatccgtaacttcgggacaacagctcaaatttgaaatctggcgcaagcccgagttgtaatttgtagaggatgtttctggcgacgtgccttccgagttcttgggaatgctgctctaaatgggaggtatacgtcttctaaagctaaataccggccagagaccgatagcgcacaagtagaggcgatgtgcatgtgctgtggttggatttgtggtggtgcatgcacgctgtggtggaatttacagtggcgtgcattcgctggggttggatttgtggtggtgtgggtgcgctgtggttgattatgtagtgggttgggtgcgctggggttggaattttagcggccacttcggtccttcaagttctcattgaagtatttgctactaccaccaagatctgcactagaggccgttcaacccgggcgcacgccctaggcttcgtcactgacctccacgtccgcctactcctcagggcatcgtttctaccctgagggcgaggtatggtccgccactagatttaggggccggccgtccctcgcgggctttggccgatccccaacaccacgccctaggggcatgaggggtgaaatgacgctcagacaggcatgcccgccagaatactggcgggcgcaatgtgcgttcaaagattcgatgattcactgaacagctccagctcgccatggatagcgattatgatcgcaagttccccgttgaggaatatgacaagaagtacgcgatggacttatatattgggagtatggatggggttgatttgtccgcctgaggagtaggcggacgtggaggtcagtgacgaagcctagggcgtgagcccgggttgaacggcctctagtgcagatcgtggtggtagtagcaaatacttcaatgagaacttgaaggaccgaagtggggaaaggttccatgtgaacagcggttggacggccagagaccgatagcgcacaagtagagtgatcgaaagatgaaaagcactttgaaaagagggttaaaaagtacgtgaaagtgttgaaagggaagcgttcatgaccagacttgggcaggttgatcatccgtggttctccgcggtgcactctgcctgcccagaataatcagcttcgcgagctctttgaaatactggccttctcacttccctccgatccgcgtggaaggcgggagaccggtgtgaagttggggtaccgggtaggcagaaaccacaaccagctaccctatacccggcgaactcaaaccaaatctgccgccgcgatgcactttgcagcgacctcctcgatgcagataatacgtttgctcggacttctggtaaatatatccaagtggttgtagggctcaaacttttctgccaatgttgctgcggaggattcttggaagagagctgtaagtgtattcattgcagcgtctcactctatgtttccaactaatgggacggtacagttgaagagatttcccacagcggatcggaccagcttgttacagttgacccgagacgctgtgagtggtttgctgcttttctaattctttttaatatattattttataattaaattagaataagtatttagtataataaatttattttctattaagttactagattatagtaaaatattaaatattcttataatctatatatatcttaaccttatatattattccgagtcgcaagccagcttccacagagccgtattcagccggagacaggaacaaggcgtgagccctctggttttgagagagttgaaggcaccaggagagccccaagcaaatgcagcaaatgtcacgccgttggccacataatgacctcaaagaactgtcctccatgcatgtctaagtataagcaattatacggcgaaactgcgaatggctcattatataagttatcgtttatttgatagtatcttactacttggatattttccgcaaaattcattactatgggaaatctaaaaaatcaactcacaaccaccaaaccgttcgaccgatatatatagcctttttaagacctacttttatctgaaagaggctcttaagctgatcagttgagtatagatattagataccttatctttaaagggatcggccaaagcccgcgagggacggccggcccctaaatctagtggcggacccgtcgtggcctcctctgcgaagtagggatattccgcatcggagagcgacgagcccctgccgttaaacccccaactttccaaggttgacctcagatcaggtaggaagtaggagagagcttcggcgcatctccgaccgatcctgatgttctcggatggatttgagtaagagcatacggggccggacgcgaaagaaggtgaactatgcctgtatagggtgaagccagaggaaactctggtggaggctcgcagcggttctgacgtgcagtaggagagagcttcggcgcatctccgaccgatcctgatgttctcggatggatttgagtaagagcatacggggccggacacgaaagaaggtgaactatgcctgtatagggtgaagccagaggaaactctggtggaggctcgcagcggttctgacgtgcaaaggttgacctcagatcaggtaggaatacccgctgaacttaagcatatcaataagcggaggaaaagaaaccaacagggagtgccctagtctttaatatacgctattggagctggaattaccgcggctgctggcaccagacttgccctccaattgttcctcgttaagggatggatactgggctacaattcaactaccaaaggcatatatgtaatttcgatcgccatcctagttggagcacttgtgatttgtcatggccacacccagtcttgcctaattcttgcaccaggcatttgaaaatgacccggcagtcatcatccgcatttctcgcttaagcaatttttatttttgttatgtcctagaaaccaacaaaatagaaccacacgtcctattttattattccatgctaatgtattcgagcaaaggcctgcctgtagcactctaattttttcaaagtaaaagtcctgtttccccgctacacccagtgaagggcatagggttccacagagggaaattccgacatctattagtgagctacgcttaatgaccacacaaaaatcagccaagcccacaatattaaaccgcgtcaaagctagtctgtttacttctccccgacgcgtgccattccttcctaatcgacgcttagtccgatggaatctaacaacgtcatgctcttctccccgacgcgtgccattccttcctaatcgacgcttagtccgatggaatctaacaacgtcatgctcccttccccaccctcttagggggaggggatattagggttacttagggttagggttagagagtattttagagcagtatagggttagggggagggaggattagggttacttagggttagagttagagagtatttagagttagtatatagttagaggtagtatatagcttaagggagtaggtgcaccgacccacatttacccgcgtgcacgccacggtcggttcccgggccacttttgattttccgcaaaattcatttgtatgggaaatcaaaaaaatcgacctacataatcaaccacagcgcacccacaccaccacaaatccaaccacagcgaatgcacgccactgtaaattccaccacaccgtgcatgcaccaccacaaatccaaccacagcacatgcacatcgccgggaaccaaacttcagcacatgcacctcactggaccatgtatcagtatttattgtcactacctccccgagtcgggattgggtaatttgcgcgcctgctgccttccttggatgtagtaatgaaagatggcgagcacagtggcagcaggaaatcaggggccgggcaacgttccgtcacacccccgagccgacacctaaggtgctgcagctacacgagcacttcagcaaaagtcatgtatatcggtcgcgcggtttggtggccgtgagtcgatttttttgatttcccagacaaatgaattttgcggaaaatcaaaagtggcccgggaaccgaccgtggcgtgcacgagggtaaatgtgggtcggtgcactaatatctatactcaactgatcagcttaagagcctctttcagataaaagtaggtcttataaaagctatatatatcggtcctggccaaggcgaggaggcagatggggaagaggatagcaccattaaccaaggcacctcagaccatctcatctaccccagaaatggtgggatcggggagattgacaatgctgaggattctatagatggcatgggggcgatcaagtttaccgacgaagaagactggggatattttggttcgtttttggctaatgctctcgtccatgggcaggacactcgcaacaacgtacggccggcctctcatgatatcttccagggctgccagaacccgcctccccttgcgtggatctgagactctgccctgcgtctcatcagccgcggcactgaagctctgggacatgctacgtgagcaccgcgcaaagggcactgcagagctgacttttggcgcgactgaccccgtcgccgtgagtcagatggccaagcatatcctcattgtgtctggacctggtgagtttccccgtgttgagtcaaattaagccgcaggctccacccctggtggtgccctttggattcgtggcccgacgtccaagccgggttgaagcgcatccgggccgaatgcggatgtgaactcttcgtactcgccaacggcacgacccgccttcaactcgacttggttcgatcatcgagattgaatgcctgcagacgcttgagggccatagtagctgggtatgctcagttgtgttctcagtggatggccagcaggttgcatcaggttcacatgataaaacaatatgaacatattcccatcccaaaaatccgatggcttgacctttctcaccgtggtaagatagtcgtgcatatggacctctgcatgatcccttaacgaggaacaattggagggcaagtctggtgccagcagccgcggtaattccagctccaatagcgtatattaacgttgttgtggttaaaggattctaagtgggacttagcgaagatttgccctaggtttcaattggaccatgtctagtcccgaattccagtcgcagaccctcagcatcatcgaccaactcttacgcggatccctgttgacgggggttccgaacctggaatttgttctaatatcctaggatttttcccggattttctagacccttatctgggctagataagcccgataacctaataatagctctgcttgtggcccggattcatttgtatgggaaatcaaaaaaatcgactcacggccaccaaaccgcgcgaccgatatacatgacttttgtaaacccattcatttgtatgggaaatcaaaaaaatcgactcacggccaccaaaccgcgcgaccgatatacatgacttttgtaaaccaataataggggtgggagggttgaagacgcgaaaacgcggtgtgggtctgggtgttcgcaaacttactgcccataatagtaggacaatgaaatgagtaggagtaattaagaaatgctaagggtgaatgatacacaaaaggctcgtataagccttggatgatctctgttagttcgtcttctacctcactgaggctcgcaaacggcccgctctcggcctcagtgccccctgctgctggactggcaaacgacgcaagattagagagcaatctgtcagacgcgaacggtgtcacatctgagtcaatccacctgaacatggcggcaatctccctcagggactttccagggggtgaggagacaataaatactgatacagggttcttttggatcttgtaattggaatgagtacaatttaaatcccttaacgaggaacaagtggagggcaagtctggtgccagcagccgcggtaattccagctccaatagcgtatattaaagttgttgtggttaaaaagcaactcggtatccttctgtatctaccccaggaatgcctcgtgcgttcagccgatttgctatcgctatggacattacaagagaggatacaccccttggaaccgacctacctccccttgggggaaccgggaccagaaacgctcttattgatgttgcgggtggtatcaccgctttctggcatggattctgacttagaggcgttcagccattatccagcagatggtagcttcgcggcagcggatcggaccagcttgttacagttgacccgagacgctgtgagtggtttgctgcagcgccttaggctttcgccttccgcactcgcgcccctctctcataggtgcaccgacccacatttaccctcgtgcacgccacggtcggttcccgggccactttctcgtattgcgctgtatcagctgcattagcggtcctcgtgtccgctgtagcagctacattagcggtcctcgtgtccgctgtagcgcttgcattagccgcctcggaatgtccttttgtttgggattctattgtaggatatatggtgctgtactgaggcgggccggtaaacgccaacagtttaatatacacaaaagcaaatatatatagtttcagcggacaccgccatggttgaagctgtgcgctgagcactcctcttggggcgcccaagccgcaccggccctagtggtctgggtgtggtggaaggatgccctggggaactgagagggggaaggtggattgccgtgcgcggcgtcggtggccctgccgctggaggagtggggaggcatacagactgtaataatcttctgctcttaacagtaggtctcaaagtcagctgagtggtagctcttatagctatcaaggattagcattcggaatacccccttcgtacgaggagctgtataggaattaaagtacttaatccaatccagaacttagaggcgttcagccattatccagcagatggtagcttcgcggcactgcccggtcggacagccgcaaaaaccaattatacttagaggcgttcagccattatccagcagatggtagcttcgcggcactgcccggtcggacagccgcaaaaaccaattagctgaatgagcggttcctctcgtactaagctcaattaccattgcggcgaggtcatcagtagggtaaaactaacctgtctcctgcttacaggaccgtttcgcacagctaagtcgtctgcaaaggatttgaccccgctcgttttaaaattacaatacgcgacatactacagcacacttctagtaccgtagagtaatcgcctgctaagacgctaagccgaagcctattcttgtccatctgtaggcccgtcttctgcatttcgtgcaggtgcttcgttcggggacgtctcttgcattgccagttgctgcgaatggtccatggctgttaccctcgtgcacgccacggtcggttcccgggccacttttgattttccgcaaaattcatttgtatgggaaatcaaaaaaaccgattgaatggctcagtgaggcgtccggactggcccagagaggagggaaaccaccactcagggccggaaagctctcccgccgtaatgattaatagggacagtcgggggcatcagtattcaattgtcagaggtgaaattcttggatttattgaagactaaagccttgcgaccatactccccctggagcccaagcactttgatttctcgtaaggtgccgaacgagtcaatttttaacatcttccgatccctagtcggcatagtttatggttaagactacgacggtatctgatcgtcttcgatcccctaactttcgttcctggaattatttatttaatctctctctctctctcttataagtagtaagtttattcctattcttatttatatagttcctttaacgtgatccaccaccatgtgggccataccaccatgtgggccactttccttaattttttatatcttcttcttctaatagcggttcctctcgtactaagctcaattaccattgcggcgaggtcatcagtagggtaaaactaacctgtctcacgacgggctaaacccagctcacgttccctattagtgggtgaacaatccaacgcttaccgaattctgcttcggtatgataggaagagaccgcagagatcagtcagggggagccgcggctagttatcaacacgcaaaaactttaggttctaagatctagaacggccataaatccagaaagactacttagttgaatataagctctgctgctctctgtcatcctttgatagatcagggcttgagaagaggttatccaagaagacgtgatatatagctggcggcagccgttttactaggtcaactaccacagcctgtgtcgggttgaggctgtattcatcatgccttttcctctaataaacgataacttatataatgagccattcgcagtttcgccgtataattgcttatacttagacatgcatggcttaatcgttgagacaagcatatgactactggcagaatcaaccaggtaactatcgttcgccggggttggccaccagcgcccacgaggattctggtccactctagatccacgctggccacacgagctaaactcaagtggctatgctcgtaatcaagatgcctgtccgaataatacagtatggatggacatcggcgttaaatgcattggattgcttaatgaggaacatcaatttctcattttactaggaaactttcactgcccaccagaaaggctttttttcctcatcgttttaggggtttcgagatccccgcagattccaggtaagacaggctactcgaaaataagttttaattgtctccctaagcttttatacgtccgcctataagttcgggcgtagatctatgctttcttgagccatatctctcaacttcctgattcacttgttaaaactgcaagaaatcctgaccgacgtggtggcacactacaacgacgacgagtctgccacccatatctctcaacttcctgattcacttgttaaaactgcaagaaatcctgaccgacgtggtggcacactacaacgacgatgagtctgccacagcagacgaaagtggcgacgcgttaccacattacagatatggtggcgaggagcccaacatgatgtttagtccctgatccgtgcatctttcatcaactgatttccgctggcgatcagaccgtagtgtatggcgggatcgtcatcttccacgtctcggttgtcacgagccaccaggtaaggtgctcagcgcacagcttcaaccatggcggtgtccgctgcacgtggcgatctcccgttgctcagtggtaagtttagccagcattctatttaattcttttctatttaataatactaattaaaataaatatttatttatttaacttaaagagctattttaatataaattaatttaaattagtatattatctactagtactatatatagtactttagattataataattattaaatactagaggaatattattatagttctctataagtatattattaaagactagatctatctttatactcttactagctataaaatagagtaatagttctagtaggtataactactaggcctatatataagagaatagctttattactataagtaagtttataataaagtataaacttaaataattaatatctaaaaagaaattctaatagttattactaataactattattatatatataaaaacctagttatttataataattaggctttagctatagagaataattatattagagatatttattattactattataaagatagttaataataaattataaggagagatagtaataataagtttagagaggtattatagttaattatagataataagtattcccctttagaacttatagctaaattatatatttaataaactctttttagagtttttaaaattactattatttatatcttagctagttatataataaaaagtaaaaaaaaaatagaattaaaagttaaatatagattagaatttagttaaaaactaattatatagattatattatatatagcttaatcttagaatattaccccttatatatagtaaaaacccctaaaaaaaataaaaaataactataagtacttactagatatttaataattaattaattaattaattagtactttaaattagaaagaaaaaataattattattattagataataaattttctcttttaggagctataaatataattagattatttatatatctagctatataaatagcttctattattagagtttttaaaatattaatatctatatttagattaaaggtataatatttaactttatcttatagtattaaaaatttaaaaaatttttaagagtttttactatatataaagaataatattctaagattaggctatatataatataatctatataattagtttttaattaagttctaatctatatttaatttttaatttttttttttttactttttattatatagctagctaagatatagataatagttactttaaaaactttaaaaagagcttattaaataaccacccgcacgtacagatggacaagaataggcttcggcttagcgtcttagcaggcgattactctacggtactagaagtgtgctggacaagaataggcttcggcttagcgtcttagcaggcgattactctacggtactagaagtgtgctgtagtatttcgcgtacccgcggattttcaagggacgtcgagagcgcaccagacccagcagaggtgctgggctcttccggccattaaaccctagcgccggacaaaccgatttcagggtgatagaccgttaagaagaaaagagaactctgcctggggcccccgccgtcgtctccgcgcaatgggctttcctcaacgctacgataaagcaagttataattggtgtttggactataagcagatgggtaaacgatgcacagcaacagaattttgattttcagtgtgaatacaaaccatgaaagtgtggcctatcgatcctttagtccttcgacgtgtgaagctagagttgccagaaaagttaattgttttatcatgtgaacctgatgcaacctgctggccatccactgagaacacaactgagcatacccagctactatggctctcaagcgtctgcaggcatgaagagatgggatggcgggtttacaaaagtcatgtatatcggtcgcgcggtttggtggccgtgagtcgatttttttgatgtcccatacaaatgaattttgcggaaaatcaaaactggcccgggaactgaccgtggcgtgcaagagggtaaatgtgggcccagggaggaagccctgtacttataggtgtttcagggctccaagagctctgaagataacacgttgccttctgtaatacggactcataactgctgtaaggttctcgtacagcagatacgaggtccgctaatgcaagcgctacagcggacacgaggaccgctaatgcaagcgctacagcggacacgaggaccgctatgcggaaaatcaaaactggcccgggaactgaccgtggcgtgcaagagggtaaatgtgggccggtgtatttctgaagagtacacgctcagtagaccggccctccctgtatctagccactgtcctcgacttacagcgcttcccaccctctaaaacaataattcaccgcggctcttaacaacttttttgattttacataccctgcagcgcccgcgggacgccctcccatgagcctgggtactcagccagtctatctttacatcccgcacatctccttctccagtatcttaggcgatatagccttcagggtagcttagaagagactttcgttcctgattaatgaaaacatccttggcaaatgctttcgcagtagttagtcttcaataaatccaagaatttcacttctcgcctttttcttcatgagtgtctacttacagagcacgacggaattgactggcgcttgttggaatttcgctgggttgtcgattcgatttgctcaagccctcggtttgcattgcaattcctacccggttatcgtgagacctggcgactatggcagagtgtcctccgaaacggatggctacaactcacttcgctggcggatatgggccgcgcttgtgttaatggacaggtaatgaccgcaataccatcccacgtcgctagttgccgaggctaacaccgggtgcagatcgcgaggcaccaggcacatgtataccgcggcccaacacggcggaagaatattgcatactcagtgggaggactggaaagacagcagagcgggaggagcagcggcaaggaagacggcgatggtgaggtggccgggctcgaccagacgatatctcctcgtctcccccatcctcagcgaagccaaccacgcccaacttagctctcaattaaaacaatatcagtcatgcttctcgatccaagccaccctgattattggacacaagcccttcagtttacagaaaccatacaccgagatgtatatccgaccaataatttaccgcggctcttaacaacttttttgattttacataccctgcagcgcccgcgggacgccctcccatgagccttggtactcttcagaaatacaccggcccacatttaccctcttgcacgccacggtcagtccagcctggtaaccgggagtgggcaactgtgatccaaggggtaaatgcagctggctgggctatccctccttttattattctagctgcctaatattatcttgagaactggtatcgggaatgcaatctgctgtacgattggcggcttgcaataactgagaatggctggactactaatgaggttggtctggattggattaagtactttaattcctatacagctcctcgtacgaagggggtattccgaatgctaatcctagcagaattcaaggcagcttgattggaagccaacgacaacagcagagatctatctgtggctgggctatctagtttatatagggattcatagggagacacgatattctgactactggaaggctccccaagccggtcagcagcttccggtccatccaatagcagaagattccaaaataaaacaagaattaagtttcctaggcgggcgcctgatccggggcacacgaggcgcccggggcaagcccgccgaagcaacagtaggtatgttcacatgggtttgggagttgtaaactcggtaatgatccctccgctggttcaccaccccccccccccccccccccccccccccccccccccccccccccccccccccccccccccccccccccccccccccccccccccccccccccccccccccccccccccccccccccccccccccccccccccccccccccccccccccccccccccccctccccccccccccccccccccccccccccccccccccccccccccccccccccccccccccccccccccccccccccccccccccccccccccccccccccccccccccccccccccccccccccccccccccccccccccccccccccccccccccaccccccccccccccccccccccccccccccccccccccccccccccccccccccccccccccccccccccccccccccccccccccccccccccccccccccccccccccgccccccccccccccccccccccccccccccccccccccccccccccccccccccccccccccccccccccccccccccggatacgaggtccgctaatgcgagcgctacagcggacacgaggtccgctaatgcagctgctacagtggttacgaggttcaggatacgaggtccgctaatgcgagcgctacagcggacacgaggtccgctaatgcagctgctacagtggttacgaggttcgctaactaagtgctaaggttctcgtacagcggactttcgcccccatgcccatatttgacgatcgatttgcacgtcagaaccgctgcgagcctccaccagagtttcctctggcttcttcatctcgcttcctcttccttgatcgcggctttttatcgccaacagcatcaaataccttctgaggcaggtgcggcagccacgaaaggaaatagccagcttcagctatagcccagattttgaacccttctggcgttggctttgacttgataatcactttagtcaatttttaacatcgtccgatccctagtcggcatagtttatggttaagactacgacggtatctgatcgtcttcgatcagtcaatttttaacatcgtccgatccctagtcggcatagtttatggttaagactacgacggtatctgatcgtcttcgataccctaactttcgttcctgattaatgaaaacatccttggcaaatgctttcgcagtagttagtcttcaataaatccaagaaagtcaatttttaacatcgtccgatccctagtcggcatagtttatggttaagactacgacggtatctgatcgtcttcgatgccaagcagaactggcgatgcgggatgaaccgaacgcgaggttaaggtgccagagtagacgctcatcagacaccacaaaaggggttagtacatccagacagttggacggtggccatggaagtcggaatccgctaaggactgtgtaacaactcaccaaccgaagctattccggcagcagcagcagcagggtgttaggggtatatggctcagtgcagagcgggtcaggaagggggcaggggaggggttcccgggccacttttgattttccgcaaaattcatttgtatgggaaatcaaaaaaatcgactcacggccaccaaaccacgcgaccgatataggaaccaaacttcagcacatgcacctcactgggaatgccaccaaagcatattcacacacaacacacgccacctaacctacactttacataacctatactcaacataacctggcagaatcagcggggaaagaagaccctgttgagcttgactctagtttgacattgtgaaaagacataggaggtgtagatctcggtggtcgccgtatcattaaaaaataccactactcctattgtttttttacttattcaatgaagcggggctggatttacgtccaacttctggttttaaggtatggggtgagccgctcgcttcctgatacgttagactctcttccaacaagcacctgggttaccatacctccagtatccggatcatcctcgcgtttcctctttgtagacctacgcaattcttcataagccacgtctacgctagtctccttaatggggtgagccgctcgcttcctgatacgttagactctcttccaacaagcacctgggttaccatacctccagtatccgggtcatccttgcgtttcctctttgtagacctgcgtgatttttcacaagctacatttacgctagtctccttatattcgcggcgtctctgtcctccgtaagtgcctgcggtggtgctgggcaggccgtacaataaagcgacagaccaagcagatgcagctgctggatctgtgatgttgaaagcggcttcgtcgccgcaagcaggccctcgactgaccggaggggtgtataacgaatgtggtcgagcataagattattacagtctgtatgcctcctcactcctctcaccttcttcagccattagatgttggctgctttggaccactaaagcagttgtacggaagagagattgagaagttaatgcggatgcatattacccatatcagtaagcttgagtttctctcttcctttcgtacggctttcttccactcctttaccttattagctgacttattgagttggcgataagttgtaggcgtagttatctcagaagaggagggttcgtgagctggcgacggcgtgttgagaggttgacgattgagaatatcctttacaatactagtgggccatttttggtaagcagaactggcgatgcgggatgaaccgaacgcgaggttaaggtgccagagtaggcgctcatcagacttgagctgaggaagggagatagttagcaccaatattcaagataatgaacaccgaacatcagtcttgcagcagagaggaactgcaaaaagaggggcgggcaagggtcataattcctgcacctcacataacctgcaccccacaggctatctcaccgcctgtagctcacgctcagtagaccggccctccctgtatcttataagaatatatacaatgagtgtaacttaggctcctttcgcataagttgatctgaaaataacccacgccgacatgtgcgaaataggcataagtgtgctagtaagctatgcggaccgaaacgccgccccgatcttgcagtatgcctgctccattgggacgtttgacgctgtccaacagctcttggacaatatatagctagatatatataaataacccagctatagctatagctcctaagaggggaagcttattatctaatagtaataactacctttcctttctaacttaaagcttactactaattacttaatgaagcaacagtaggtatgttcacatgggtttgggagttgtaaactcggtaatgatccctccgctggttcaccaacggagcccttgttacgacttttacttcctctaaatgaccgagtttggagagctttccggccctgagtggtggtttccctcctctcgctcagcgcacagcttcaaccatggcggtgtccgctgcacgtggcgatctcccgttgctcagtggtaagtttagccagctgccatccatccgtgggaggacagaccctggctgccgcagcttctatcagacagggagcgggcggcgagggcaccggcgctaatagcagagcataggatcttcatggcgagagtgggttatttgtgtacaatacaatacaatacaatttattacgcccagcggcttattttaaagggtaaaagtccccttgattttgattttcagtgtgaatacaaaccatgaaagtgtggcctatcgatcctttagtccgtcgacgtgtgaagctagaggtgccagaaaagttaccacagggataactggcttgtggcggccaagcgttcatagcgacggggctttctcattcgtgagacggattgaccgaggaaacggagtcgctgacaatgccttgattttcggtgctaaattttgcgggctttctcattcgtgagacggattgaccgaggaaacggagtcgctgacaatgccttgattttcggtgctaaattttgtaaaggggaaattccgctgaatatcaacgagaatataaagagtgctgaggcctagagtagagcacggtaaccagaccggaagaatcgctcgattattcaccgaggagtcccgaagataaggagactagcgtagacgtggcttatgaagaattgcgtaggcctacaaagaggaaacgcgaggatgatccggatactagaggtatggtaacccaggtgcttgttggaagagagtctaacgtatcaggaagcgagcggctcaccccatcgggaaggactgggggtttaacggcaggggctcgtcgctctccgatgcggaatatcactacttcgcagaggaggccacgacgggtccgccgccttgcgccggcgatggttcattcaaatttcttccctatcaactttcgatgtttgggtattggccaaacatggttgcaacgggtaacatacctcaacggctgagagctgtctctcggaaaaaatccgattcgccaccctcatcagaaactggcgactctggttcagaacagcaggtctttgggcgccttggtcggtggatactgatgtgtcccgccccggcggggtatcctcgtgaagctgccggaggacgtcggccgcgtgggcaattcgtctcagtccgggttgaaggcgttcgagaggaactgcgcgtttcttggccattccggcaggtcttccagttctcgtgcgttgttaagggctgcttcaggtgtgttgttcaggggtccggtgtatatgccgccgtaacgcaatatgcgtttcagctccttggcaagcgtcggaggagcagcttgtgtgggtaagggatgccaaaatcggactctctgactacctcgaccgctggtaccgctgcaacgggccggttgggcttgcacattcggtctttgatatgtccttttcttgcggtttcacgactgtggcaccaacgttgctgcgacgtctgttgatagcctttgactgtcgatcaatcattgtccccttgttataatttcacaattgtaacgccatcggtgtttgtaacgcgccctcagggtagaaacgatgccctgaggagtaggcggacgtggaggtcagtgacgaagcctagggcgtgagcccggggtgaacggcctctagtgcagatcttggtggtagtagcaaatacttcaatgagaacttgaaggaccgaagtggggaaaggtccaacagggattgccctagtaacggcgagtgaagcggcaacagctcaaatttgaaatctggcgcaagcccgagttgtaagttgtagaggatgtttctggcgacgtgccttccgagttccctggaacgggacgccatagagggtgagagccccgtacggtcgtcaccaaagttgactctcttctgggctctcttggccggcgacttgctccgtccagcccttgattgtcgcggtgggtccaaagagccaggctgtggatgttgaccttgtgctgctctgtaggcataagaaaccctgtgtctcggctgccgtcctgttccacgtttcgtttgctgcttttccaagctcacttccttcccccatcgtgggcgtactgttgaacggacctggtgctctttttcagcgcaagggtgggtttcactccttgcggtatggctagctggctggcattaacacaaaacacaattacgctagccaatctgtcatctgtcatctggctataaagggccctctggaggctggctgtgccctggaggcgttagttgtgccttcaggctataagcgcaagggtgggtttcactccttgcggtatggctagctggctggcattaacacaaaacacaattacgctagccaatccgtcatctgtcatctggctatacacgtcagaaccgctgcgagcctccaccagagtttcctctggcttcaccctatacaggcatagttcaccttctttcgggtccggccccaggcatcctcagtacgacgtaccgcacgcggccgctttcgtgagggtcgacgcccactatgaatcacccgccagcgaagccgccaggcatcctcagtacgacgtaccgcacgcggccgctttcgtgagggtcgacgcccactatgaatcacccgccagcgacgccgaagccgtctagcctgtccaagtgaccactcagtgggaatctgcaagatacggtacagttgaagagatttcccacagtgcctcgcgatctgcacccggtggaagaatatcttctcctcccccggtgggagcgttgctgtcagaaacacaagctgccccccccatgactgcaagatcccccccagtgctgccaacgctggccggaaccgcccgactccgtccagaaccacgtggcacagtatgattattatcgagtcttcgctgacgatgccacttatcatcacggtcatggacatgcttattcgaactatgaggtcgacattgtctattactacgatacccttgttgaaggcagacaaaaacgttttgctgccttcgttgtggccttccgtatgttcttgacgaactggggtcagccgtacaacttcctcggagtttgctgccctgtccccgaccaaaagaatggctgggcatgcggcccaaggccttgtgtttgcagttcctgcagttgttgtgttatgatctggaggatgtatgcccctgactggcctctgggccttgccaccgacctgatagctgcctggttatctgtgtagatcagtattttcttgcgttcaaagattcgatgattcactgaattctgcaattcacattacttatcgcatttcgctgcgttcttcatcgatgccactctttcttctctttcttctctttcttctctttcttctctttcttctctttcttctctttcttctctttcttctctttcctttcctgttttttgcccctgttttcccgttcctggcccgtgcgctagatccggaacttggatttgatgagcgggtttggggaccatgacatccagctgacggctgcagaccctgaggggagcagccccggtgctggtgctggccctacggtaggcatccgccttggaccgtcgacatccttcctggcggcggggagacagctggcagagacactctcaccatgatcatgcaagcacccggccagttacagggcacctaccctactaaaacaacccacaacagtatacataatgaaggcaatatatagcccccgggtccctaatcattcgctttacctcataaaactgagttcaatactgctatcctgaggggcgttggattgttcacccactaatagggaacgtgagctgggtttagaccgtcgtgagacaggttagttttaccctactgctgacctcgccgcaatggtaattgagcttagtacgagaggaaccgctcattcagataattggtttttgcggctgtccgaccttacgcaaccagcacgggcctggaggacggtggcacgcttgtagtaagaagcgtacgcgtcggcataggcatcggcaatggcatcgcgacgggcgaactcgcgggtctcttcaagctcacgctccccaagttcgacgtgctgcgcagcagcaacggtggggtgattcatgataacttctcgaatcgcatggccttgcgccggcgatggttcattcaaatttcttccctatcaactttcgatggaattgggaatgatatctctgcggagatttgacgtacggtccttcgtctacttccacgcttgtagtctgaattataagcacatcctgagatcaaaaggtaagcagacggtcgtgtgcccatgctaagggaggcaaaagggcgtacggagcctagagtctggcgatctcccgttgctcagtggtaagtttagccagcggccatccatccacagaacccatccagcgccggcgagagcagagcggtggtcagaataatcagcttcgcgagctctttgaaatactggccttctcacttccctccgatccgcgtggaaggcgggcgaccggtttgaagttgtgacgtagaggcgttcagccattatccagcagatggtagcttcgcggcactgcccggtcggacagccgcaaaaaccaattatcttgtggttggatttgtggtggtgcatgcacgctgtggtggaatttacagtggcgtgcattcgctgtggttggatttgtgggggtgtgggtgcgctgtggttgattatgtagtgggttgggtgcgctggggaaaagttaccacagggataactggcttgtggcggccaagcgttcatagcgacgtcgctttttgatccttcgatgtcggcgcttcctatcataccgaagcagaattcggtaagcgttggattgttcacccactaatagggaacgtgagctgggtttagacgtattgaactcagttttatgaggtaaagcgaatgattagggacccgggggctatatattgccttcatccattctcaaacgttaaatatgtaagaagctcttgttgcttaattgaacgtgagcattcgaatgtatcaatactagtgggccatttttggtacatctaattagtgacgcgcatgaatggattaacgagagtcccactgtccctatctactatctagcgaaaccacagccaagggaacgggcttggcagaatcagcggggaaagaagaccggactgaggttcgcgctctgcaaggatgctggcgtaatggtcatcaacgacccgtcttgaaacacggaccaaggagtcggcttcgtatgcgagtgttcgggtgtcaaacccctacgcgtaatgaaagtgaacgtaggagagagcttcggcgcatctccgtctttttctgttgcgcagccgacgctaaacaagtccgaacagagtccgggacttcccaaaatggggccgaggatagcaagtcgtgtctctgttgtaatgaagcaacggttgataagatggtaatagaaataggtaaaaaagtgacaaaccacgcccaataaagaccgcatgctgtaccaaatcacgcaaaagacattgctcgatccaatgcatcctctcattatcctcccgttccagggaactcggaaggcacgtcgccagaaacatcctctacaaattacaactcgggcttgcgccagatttcaactttgagctgttgccgcttcactcgccgttactagggcaatccctgttggtttcttttcctccgcttattgatatgcttagccattatccagcagatggtagcttcgcggcactgcccggtcggacagccgcaaaaaccaattatctgaatgagcggttactctcgtactaagctcaattcctaggcttcgtcactgacctccacgtccgcctactcctcagggcatcgtttctaccctgagggcgaggtatgggtgagccgcttgagcgccatccattttcagggctagtacattcggttggtgagttgttacacagtccttagcggattccgacttccagtattgaactcagttttatgaggtaaagcgaatgattagggacccgggggctatatattgccttcatccattctcaacctttaaatatgtaagaagctcttgttgcttaattgaacgtgagcattcgaatgtatcaatactagtgggccatttttggcagaaatacaccggcccacatttaccctcttgcacgccacggtcagttcccgggccagttttgattttccgcaaaattcctttgtatgggaaatcaaaaaaatcgactcacggccaccaaaccgcgcgaccgatatacatgacttttgtaaacccgccaagggtgcgctgtggttgattatgtagtgggttgggtgcgctggggttggaattttagcggggtgatacacgctatggctgaggctttcgccttcagcactcgcgcccctctctcataggtgcaccgacccacatttaccctcgtgcacgccacggtcggtaggctttcgccttcagcactcgcgcccctctctcataggtgcaccgacccacatttaccctcgtgcacgccacggtcgggtcccgggccacttttgattttccgcaaaattcatttgtatgggaaatcaaaaaaatcgactcacggccaccaaaccgcgagaactctggcgtccttgtaatccatctcccaaaccccctacgcagccagccaccagggccgcctgtattggggaaatcgagaactctggcgtccttgtaatccatctcccaaaccccctacgcagccagccaccagggccgcctgtattggggaaatctaggcgaaggacggcttaccctcagcagatcgtaacaacaaggctactctactgcttacaggaccgtttcgcacagctaatcaattttcagtgattaacatcgctccttaacaaagtgttagctataaagttgtgtggaaaagtaaattcacaagcgctgttagacagaaggctacaatccaattgcacttgtaaggatgcacttacggaaacactgttaggctaagggcatacgtggtatagatcttaattatatcaagagcatatgccgacgatttatcatgtgaacatgatgcaacctgctggccatccactgagaacacaactgagcatacccagctactatggccctcaagcgtctgcaggcatagtgcccctcgtgggcgctggtggccaaccccggcgaacgatagttacctggttgattctgccagtagtcatatgcttggctcaaagattaagccatgcatgtctaagtataagcaattatacggcgaaactgcgaatggctcattatataagttatcgtccgctgtgggaaatctcttcaactgtaccgtatcttgcagattcccactgagtggtcacttggacaggctagacggctgcggcttcgctggcgggtgattcatagtgggcgtcgaccctcacgaaagcggccgcgtgcggtacgtcgtactgaggatgttcaacccgggctcacgccctaggcttcgtcactgacctccacgtccgcctactcctcagggcatcgtttctaccctgacggcgaggtatgggtgagacgctctatgctgagggaaacttcggcggaaaccagctactagaaggttcgattagtctttcgcccccatgcccatatttgacgatcgataacctcgcgttcggttcatcccgcatcgccagttctgcttaccaaaaatggcccactagtattgatacattcgaatgcgcacgttcaattaagcaacaagagcttcttacatatttaaagtttgagaatggatgaaggcaatatatagcccccgggtcttccaaccccagcgcacccaacccactacataatcaaccacagcgcacccacaccaccacaaatccaaccacagcgaatacacgccactgtaaattccaccacagcgtgcatgcaccaccacaaatccaaccacagcacatgcacatcgccgggaaccagctgcctgctcccgaggcgtcctcccaaagcccaacgtacccaacccttagagccaatccttatcccgaagttacggatcttttaaatattctatttaattattactttatagatagtaagctattaaaagcttatattttatatctatttatactataagtaattaacacaaagtccaatcttcaacgcacgcctctctacgatcacgtcaagccaactcaaccggccgctctcgatgattcctcttcagccatcaaaggctctatagtttactattattatagcttactagtattaatataatagtttatttactatttatatatttactactagtattattagttattaattcttatagctatagttatatagtttatctcggtagttgacgataccttcctatcgcccgcttggctccaacagactggtggttgtgcctgaacatcggtggagctggcgctaattcctactcaagtaattacttgagtggaacatgtgtttccagtaaactcctcacattagcaacatttactcgttataacaatattgtcaagatttgtaattcaagctgccggatcgtgatttcatccaaatctcattaagtatgacaaataaagccaaggaccaatccactcaatccaatcatctgaatgccttcattgcaaccgatatatatagcttttataagacccacttttatctgaaagaggctcttaagctgatcagttgagtatagatattgacctcctatgtcttttcacaatgtcaaactagagtcaagctcaacagggtcttctttccccgctgattctgccaagcccgtacggatgatcaacctgcccaagtctggtcatgaacgcttccctttcaacaatttcacgtactttttaaccctcttttcacagtgcttttcatctttcgatcactctacttgtgcgctatcggtctctggccggtatttagctttagaagacgtatacctctgggctcttccggccattaaaccctagctccggacaaaccgatttcagggtgatagaccgttaagaagaaaagagaacgctgcctggggcccccgccgtcgtctccgcgttcagttgcgttgccgcgcaaaacccacatccaggtgccggaatattgaaaacttaattcttgttttattttggaatcttctgagtagtttttacaaataaataaaaactttcaacaacggatctctttgttctggcatcgatgaagaacgcagcgaaatgcgataagtaatgtgaattgcagaatacttttatctaaaagagactcttaagctgatcagttgagtatagatattgaatatcttatctttaaagctgaaggaattattacatttggactgctccgcttcctcctgagactgagctttctcgccaaatgacgacttctaccacatctattgacattattggtctgcaagctgcttatgctaatttgcatactgaccaagaacgtgattacttcatgcagcgttaccatgatgttatttattataaaatcgagatacatttgtaaaaattacgtcgtaatgtattggctttatagcctaaaataaaaataaaaaaaaatgcgtttacttaaaagtcatccttttttaagattatttaatgcttatttaatagatcattcacaaccaagcagatcttggtggtagtagcaaatacttcaatgagaacttgaaggaccgaagtggggaaaggttccatgtgaacagcgggtggacgtgggttagtcgatcctaagccatagggaagttccgtttcaaaggcgcactttgcgccgtgtggcgaaagggaactgcttcccgggctacttttgattttccgcaaaattcattactataggaaatctaaaaaatcaactcacaactaccaaaccgttcgaccgatatatatagcttttttaagacctacttttatctgaaagaggctcttaagctgatcagttgagtccgatccctagtcggcatagtttatggttaagactacgacggtatctgatcgtcttcgatcccctaactttcgttcctgcttactcgcgcccctctctcataggtgcaccgacccacatttaccctcgtgcacgccacggtcggttcccgggccacttttgcttttccgcaaaattcatttgtatgggaaatcaaaaaaatcgactcacggccaccaaaccgcgcgaccgatatacttctaaagctaaataccggccagagaccgatagcgcacaagtagagtgatcgaaagatgaaaagcactttgaaaagaggggattcctcgttgaagagcaataattgcaatgctctatccccagcacgacggagtttaacaagattacccaggcctttcgtccaagggagttctgatccccacctagcagggggctgttctgatccccacctagcagggggctgttctgatccccacctagcagggggctgttctgatccccaagttttgattttccgcaaaattcatttgtatgggaaatcaaaaaaatcgactcacggccaccaaaccgcgcgaccgatatatcactgcctcacttccatcatcgcgccgatggcgagcgagcaaattctcgttcatgaagggaatgtgaaggtctccgcccgcagccatagccggcgcgcggtttggtggccgtgagtcgatttttttgatttcccatacaaatgaattttgcggaaaatcaaaagtggcccggcaaccgaccgtggtacatcgccctgaagcagctgatcctttggcctcaagaaggtccagataggccgcttgcctcggccccttacgacaccgtattcatcgctccagataacacagttccagtcaatatccttatactgttccgcccaggcaagacgcttagctgcatgctcgccgtttgagatgtatgatatctcaacaagagcatatatcgtggcgttgaaagccacgagccggcttagcagtcgggaaatctcttctttaagaaaacccggagttaatgtttaccggaattcacggaacaagggtcttgtgggttgcccccccacaatggcttggtggtatcatgggtttcctactcatcccggtattcggtgaagccatcactatatggtctcctattaaattactagattatagtaaaatattaaatattcttataatctatatatattttaattttatatattatttctaaatagtagtatttaaactctttaaatatatatatatatattttttttttctattagttttactataaataaaggtatatcctaagatcaggtaatatataatctgatatatattttttaacgccactgtaaactccaccacagcgtgcatgcaccaccacaaatccaaccacagcacatgcacatcgccgggaaccaaacttcagcacatgcaccgactaaaaactactctaaaacccgctaaagctgcttcccgggccacttttgattttccgcaaaattcattactatatgaaatctaaaaaatcaacttgcccctagggcgtggtgttggggatcggccaaagcccgcgagggacggccggcccctaaatctagtggcggacccgtcatggccgagaaggccagtatttcaaagagctcgcgaagctgattattctgaccaccacttcaaaaaaagtcatgtatatcggtcgcgcggttgaatactgatgcccccgactgtccctattaatcattacggcggtcctagaaaccaacaaaatagaaccacacgtcctattaaaggaaaggaaaggaaaggaaaggaaaggaaaggaaaggaaaggaaaggaaaggaaaggaaaggaaaggaaaggaaaggaacatctccttctccagtatcttaggcgatatagccttcagggtagcttagaagagatgggatggcgggtttacaaaagtcacatctccttctccagtatcttaggcgatatagccttcagggtagcttagaagagatgggatggcgggtttacaaaagtaatgtatatcggtcgcgcgtccggccccgtatgctcttactcaaatccatccgagaacatcaggatcggtcggagatgcgccgaagctctctcctacggcggctgctggcaccagacttgccctccaattgttcctcgttaagggatttaaattgtactcattccaattacaagatccaattattcaatgaagcggggctggatttacgtccaacttctggttttaaggtccttcgcgggccgacccgggttgaagacatccgacccgggttgaacacattgtcaggtggggagtttggctggggcggcacatctgttaaaccataacgcaggtgtcctaaggggggctcatggagcagagcagaagggggtggacataagcatgctggcgtttacgcaaggatccagctgccgacgtcttctgctagacgaggtgatggatgggtcagggccctgaagggcctcgcaagccgggacgcagataagtacaggcggacggcctgtcggttcaaggcgccctggaagatcgtggatgcgacggggctgagcgaggataccttttagtagcgtgaaaattcacccaccaaatttcaacggatcctactaggaaccgtcgtggcattaatgatagggtcacacgaccacggaaatcgcgtcaggattggtcagacacggtcgccccttgttgggggcgatttttggtgtccactagggatcaataacaatatggcgccccattaccgccgagctactgcaattggtctgcagcaaactatcggtaacactgctggcgttgttgcaccacaggtgtaccgcgctgcgccgtaccgcctgggacactggtgctctctcggttccgccatcatctgcatagttctaagtatggaatactcgcaggctgtatggagtatggattaactgtattccatacaaagtattccatacgactaatccatacgtgtattgatagaaagcctgctataagtcgatgctgagatatcagaacgtcgccttatttacaaaatcatatttgtaggttctatagttctcttttcttcttaacggtctatcaccctgaaatcggtttgtccggagctagggtttaatggccggaagagcccaggcactgaataggctcacatatagaaaggcgaagtgacggcgatgccgttcttcaagttgggactcgacgaaggtgaagcagtccgggggcgagattctggtctgggatggatgtttttggtgatggagatataatacaaaaacaggtcgaggaagagatgaatggatggagaccagggcgggaaggacgagagaagatgtgcgggatgtaaagatagactggctaccctgcagccgcttcccgagagacagaccgggcgccagaactctggcgtcccaatgcacgcccgattcggctattccatacagcggctttatgattctcatgactgttccctccgggtagctttgttcaagtgatgacgctgtggaatggccaccgtattcgaaatcagaagaatcgccctcacgttgtatccggtatccctcaggacctctatcactcaacagatgctcctaattggggtgttcctctaagcgataacgaggaggctccggattggcagctaattaatgatatctgtgatgcccttagatgttctgggccgcacgcgcgctacactgacggagccagcgagtactcccttggccgaaaggcccgaccgatatacatgacttttgtaaacccgccatcccatctcttctaagctaccctgaaggctatatcgcctaagatactgcagaaggagatgtgcgggggtgatacaatcatccgatacagatcgaaatcttctctttgcgggttagtccacacacccatcgtcttgatgcctagacctcgaaacctcatacaggaggatcgtgtgaagagaatataacgaggccaaagctggcgtccccgagggtaatggttgtcgatgacgctttgccaaatgacgctttgccaaatgacgctttgccaaatgacgctttgccaaatgacgctttgccaaatgatgctttgccaaatgacgctttgccaaatgacgctttgccaaatgacaatttgcgagacgacgtattggctttcccaccatacccttagagccaatccttatcccgaagttacggatctattttgccgacttcccttatctacattgttctatcaaccagaagcaaactgtcttaatgcctccatgtcctcggtggtggctgtcttgatgctcaaatcgccgctcttgagctggttagtcaaggctactctgatatgcttaatgtgctcattgccgctttgttcaatcgcccggtctacgtgggctttgaggtttcgaggcacatttcgattctaactatacacttagaaggttgctggtggttagccagcagttcagatttcaagcatcagctatgttcgctgctagatctaccaataatttagaaagaaaagattcatcgtggtaaggtgctggatatagtatcttcactgctgtcttagtaaaacggctgccgccagctatttatcacgtcttcttggataacctcttttcaagcccggatctcttcgtggttttaagagatttgaacgttggggctaccacggaatttcatcttttcggctagccgtgcgccgactttagttaaatcaatgcattgggaatatggctccagttaacggctatacgtgagtgattaatatgattggcatctcttgatcattcaggacctatccaaccttgggggtgttgcggctccacaggctgcaagagatcgcaagaggaagcggcccggaaccttagctcttaacccgacccaaagtgttgtggttgccctagtaaatcagctgccaaaggggacattccacgtcttcattgataacctatttacctctgctgacctcttccagcaggaagtgacacttgaaccagtcttggttcacgcatcaccgcgccaacatgtagagcttttcgactttcccaaggcattctactccaagaaagatgggcagtatgattattatcgagtcttcgctgacgatgccacttatcatcacggtcatggacatgcttattcgaactatgagagaagttatcatgaatcaccagagagccccgaagggcattggtttttaatctaataaatacatcccttccgaagtcgggattcctcagtccaccccagggtattacacagtgggctataacactcccgagggagccacattcccaaagcctttatcccccggggcgatattctaataaataattaattaagtactccgggagtatcttaatatctttatagttatttaccttaataatattttaatcttcttagataatctagaaatatataaagagtatatatataaggtcttaaagaaactagaagatataaaactcttagtagaactagagaaaagttatttctatatatgcttggtgtagtactcgttgagtttctgccatgcggtgatgattgagagtctcagatagcgtcggtggtcctttcccatgccgtcagttcctttccgcttcgtctctcgccttttcctctcgaagttttctactctcctcttccgtcaacaggacaaaatcatacctcaacagcgccgtgcttgactccacaccattccatcatagcgatttctcgctagaatgaaattgctagcacttcctgcaatgaaaatggactaattatcaaaatgtaggcttgctcaagctgttcgttcgtttgctcaagctgttcgttcgtttgctcaagctgttcgttcgtttgctcaagctgttcgttgagtgtggaacgcacgcgatgccgttttggtgtcaagaagtttcctgggctatatttaattagaaacccaaggatgacttaactggggaaagagcgcgctcggaagcggagcaatcagttggcaatccaagcgccagagcgttgttgcattatcaacttgcgaagctgagttcatgggacaaacccaggcaaccaaagaggcaatctggctgagacgactcctccatgagctgaacttaggtcaaggaagagctgcaacgatcatctgtggcgctcgttaatccattcatgcgcgtcactaattagatgacgaggcatttggctaccttaagagagtcatagttactcccgccgtgcacatgtcggcgtgggttattttcagatcaacttatgcgaaaggagcctaagttacactcattgtatatattcttataggttagggatgctgtcagaaacacaagctgcaccccccatgactgcaagatcccccccagtgctgccaacgctggccggaaccgcccgactccgtccagaaccacgtggcaccggttatcactctagccgctcgtgcttgcaggcgttgcagtccctccagcgttttagtggtgtatggcatgttttgtggtctccagttggcgttggaccacgcggagcatgcatacatgatctggggtataaccactcctcggtagatcttcctcatggcatctccgaccgatcctgatgttctcggatggatttgagtaagagcatacggggccggacccgaaagaaggtgaactatgcccaaacccaccgccaaagctggtccatcaggatgctgatgtaggacaaaagaaggataaaaaacgtcgttcactacaacggcgtaattctgcgggaaagccaatacgtcgtctcgcaaagtgtcctttggcaatgcgccgtttccaaaaagagtgcaagaacaacgagcatccaacccggcataactgagcgacgttgaattcgatgctctgtggtatattccggtgcctctatgtttccgggtatatattaatatagacgggaaagccaatacgtcgtctcgcaaagtgtcctttggcaatgcgccgtttccaaaaagagtgcaagaacaacgagcagctaacccgacataactgagcgacgttgaattcgatgctctgtggtatattccggtgcctctatgtttccgggtatatattaatatatccctcctctctgggccagtccggacgcctcactgagccattcaatcggtagtagcgacgggcggtgtgtacaaagggccgggacagagagccccgaagggcattggtttttaatctaataaatacatcccttccgaagtcgggattttaagcatgtattagcgctagaattaccacggttatccaagtagtaaggtactatcaaataaacgataacttatataatgagccattcgcagtttccaagagcgatctcgtcattcgtccagcccgttgcagaagctgtaaaaaaccacttcttatatagctcgagttcaagaggaaacaattacaactcgggcttgcgccagatttcaaatttgagctgttgccgcttcactcgccgttactagggcaatccctgtttgtcgcaaagctctgggccaaccgatcagaaggcgacgacacagtcgatgcagaattcccccttgatgagcgcgacgacaataacttatcggtcgcgcggtttggtggccgtgagtcgatttttttgatttcccatacaaatgaattttgcggaaaatcaaaacttgcccgacgtcatgttccctttcttcgaatgcgtatctctcggaaaccactttcaaggttcttgcgccaattgtctctatcacacgtacggtgattgcgagtatcacgtcatgttccctttcttcgaatgcgtatctctcggaaaccactttcaaggttcttgcgccaattgtctctatcacacatacagtgattgcgagtatcacttcctcgactacaagcctaagaaccctcgtgaaggtcctgtcaccaaccctcttcacggtcataatacagtcgaatctcctatccgtactgaagaggctggtgcgctctcgacgtcccttgaaaatccgcgggaaggaataattctcacgccaggtcgtactcataaccgcagcaggggtcggagccttgcgagccttccttcgcgatgagaaccgccgtaagtggctacaacgcaaaagaccgcttcttcttccagagtgcaatgacggaacaaactatccagggcgcttttagaggtgcaggccttattccatttgacccaaaaagcgtcttgtcacggctagatataaggccgcacgttccctattagtgggtgaacaatccaacgcttaccgaattctgcttcggtatgataggaagagccgacatcgaaggatcatgatccaacccacggatcattgaccaaacctcatgatcccctactatatatgcacattcatttcttagctagaaacactctcttagacagttatcaatacaatcgctaccgccttcattgaaaagtgggccatttttggtaagcagaactggcgatgcgggatgaaccgaacgcgaggttaaggtgccagagtagacgctcagcagacaccacaaaaggtgttagtacatccagacagttggacggtggccatggaagtcggaatccgctaaggactgtgtaatgtactcccgcccgagggcatatacgactctagggaggctctccttttatccattaactcttgggcgaagcttagaggctatgctttcacgaccaccaaaccgcgcgaccgatatacatgactttttttgaagtggtggtcagaataatcagcttcgcgagctctttgaaatcctggccttctcacttccctccgatccgcgtggaaggcgggagaccggtttgaagttggggtaccgggtaggcagaaaccaagactaactactgcgaaagcatttgccaaggatgttttcattaatcaggaacgaaagttaggggatcgaagacgatcagataccgtcaagactaactactgcgaaagcatttgccaaggatgttttcattaatcaggaacgaaagttaggggatcgaagacgatcatataccgtcgtagtcttaaccataaactatgccgactagggatcggacgatgttaaaaattgactcgttcggcaccttacggcggccctggtggctggctgcgtagggggtttgggagatggattacgaggacgccagagttctggcgcccggtctgtctctcgggaagcggctgcagggtagccagtctatctttacatcccgcactgaagacattgtcaggtggggagtttggctggggcggcacatctgttaaaccataacgcaggtgtcctaaggggggctcatggagcaactggaagtcagccatagcgtgtatcaccccgctaaaattccaaccccagcgcacccaacccactacataatcaaccagggcgtcccgcgggcgctgcagggtatgtaaaatcaaaaaagttgttaagagccgcggtaaattattgttttagagggggggaagcgctgtaagtcgaggacagtggctagatacagggagggccggtctactgagcgtgagctacaggcggtgagatagggcgtcccgcgggcgctgcagggtatgtaaaatcaaaaaagttgttaagagccgcggtaaattattgttttagagggagggaagcgctgtaagtcgaggacagtggctagatacagggagggccggtctactgagcgtgagctacaggcggtgagatcccgatggggtgagccgctcgcttcctgatacgttagactctcttccaacaagcacctgggttaccatacctccagtatccggttctaatagagaagaaaagattaaaagagaagaaatagctagtaaaatggaagttgataaagaagaagattttaaatcttctaacttagaaactaaaactaatactagtttaacctctgctttaaatatattctgaccaccacttcaaaaaaagtcatgtatatcggtcgcgcggtttggtggccgtgagtcgatttttttgatttcacatacaaatgaattttgcggattacacagtgggctataacactcccgagggagccacattcccaaagcctttatcccccggggcgaactgatgctggcctaagtataatatttaactttatcttatagtattaaaggttcagatataaactactaattatattcttaaaaaatatatattagattatatattacctgatcttagaatatatctttatttatagtaaacagttcgccccgggggataaaggctttgggaatgtggctccctcgggagtgttatagcccactgtgtaataccctgggggggactgaggttcgcgctctgcaaggatgctggcgtaatggtcatcaacgacccgtcttgaaacacggaccaaggagtcgcgtaaaattgaaccaatgaaaaggcagcctgttctcgcataggctgcgaaaaccccttttaaattccgcttatgcagttgaatgttagggggtatttctcctttctgttatatcggggttaggggcctctctcttttccagtatatcggggttagggggcctttctcctttctgttatatcggggttagggggtatttctcctttctattatatcggggttgggggcctccgagaagttatcatgaatcaccagagagccccgaagggcattggtttttaatctaataaatacatcccttccgaagtcgtgattttaagcatgtattagctctagaattaccacggttatccaagtagtaaggtactatcaaataaacgataacttataggtgctggctgccgccggccggttgcccggctagtggctgcctgctcccgaggcgtcctcccaaagcccaacgtacccaacccttagggtctttgaccttctcggccgatacgaggatgacctacgtcattggagaaagaaagggccggtgggaaaactccacaatattgtcaagttcatcagatcgtcccctcagaggtgtgagctttttaagaggatctcacgcgagaacgatgaagcacaagaatatctcttggcgagtgcggtcgaaggttttggtggttgtgagttgattttttagatttcctatagtaatgaattttgcggaaaatcaaaagtggcacgggaagcagctttagtaggcggacgtggaggtcagtgacgaagcctagggcgtgagcccgggttgaacggcctctagtgcagatctcggtggtcgtagcaaatacttcaatgagaacttgaaggaccgaagtggggaaaggttccatgtgaacagcggttggacgtggtcaaccttggaaagttgggggtttaacggcaggggctcgtcgctctccgatgcggaatatcactacttcgcagaggaggccacgggtcgtgccgtctgaggcaatgcttcagctgccaaggatacggccacataggaacccagtgcaaggcaataagaaaatgcggctactgcgctcaagaccatgggtcccgttccgcaaaattcatttgtatgggaaatcaaaaaaatcgactcacggccaccaaaccgcgcgaccgatatacatgactttttttccgtctccttcgactaaggcctttaatctgccctctgctgataatccgtccatgcccaaggcatttaccgcgatgttgtaaactccttctgcgactggtagtggcagaggcgatatcacaaaggaggagcccgacataagcaccaactgagagaacgacgttccttaagtgttatcacctagctaggcaagcagccttgacaccttctaatatattagcaggctggaaagcgtctggaatgtggccagttaacatagcgattcccttgttgaatccatacgtggtttcacctcaatacacctttcaaacccggccctcaacgcccccgactacgcggcctccgtggtgcgattcatgttattcatggtgttgagtgaaagaggaagtaaaatcgatcaacagaccaacagttcaacgccttatataggcccccgaagcctcgtgcagcaacccctccaccacccggttcggacagtggccgcatgagctatgcatgcatgacttgccacctcgcctgggagggtgcagggcctctggcttcaccctatacaggcatagttcaccttctttcgggtccggccccgtatgctcttactcaaatccatccgataacatcaggatcggtcggagatgcgccgaagctctctcctacgttcactttcattacgcgtaggggtttgacacccgaacctctggcttcaccctatacaggcatagttcaccttctttcgggtccggccccgtatgctcttactcaaatccatccgacaacatcaggatcggtcggagatgcgccgaagctctctcctacgttcactttcattacgcgtaggggtttgacacccgaatctataggactagaaggaaccttataggaaccctctaagagttgttttcccttagacccagaagtagccattttaacttctcagctttaaagataaggtatctaatatctatacttaactgatcagcttaagagcctctttcagataaaagtgggtcttaaaaaagctatatatatcggtcgaacagtttggtggttgtgagttgattttttagatttcccatagtaatgaattttgcggaaaatcaaaagtggcccgggaagcaacactcatgaagaaaaaggcgacaataaattcgatgcatggctgattgaaaatatcaaagtctagctcgagaaggtccttgcttcggattattatcgagtcttcgctgacgatgccacttatcatcacggtcatggacatgcttattcgaactatgaggtcgacagggagtcgggttgcgctgtaataacccggccggatcagtacgttggttggatgggcgaggttgatgatgtgaagggcatgaaggttccatgtgaacagcggttggacgtgggttagtcgatcctaagccatagggaagttccgtttcaaaggcgcacttggcgccgtgtggcgaaagccattcttgaactgacaaaacaatggtgtcgagctatcgagttgctgatcccagattgaaggagatatagcgaaggtggactcagagggcttgtcgctgacgttgatagggagcggcattgctaggcggggatccaccatcatacggtcggcatttgtacaatcctcattgtgtctggacctggtgagtttccccgtgttgagtcaaattaagccgcaggctccacccctggtggtgccctaggttggtctggattggattaagtactttaattcctatacagctcctcgtacgaagggggtattccgaatgctaatccttgatagcgaccaaggagtcgtcttcgtatgcgagtgttcgggtgtcaaacccctacgcgtaatgaaagtgaacgtaggagagagctgcggcgcatctccgaccgatcctgatgttctcggatggatttgagtaagagcatacggggccggacccgaaagaaggtgagtcgaagaaaacagagagtgggagacgaattgttttcttcagctgtgaccgtggaggagcgccaccaaactcctcaaatgcacggcgtcggatgactatatatattattcctaagtagtagtatttaaattctttaaatatatatataataactataaattccttattataaatagaataattaagttctatactatataataaataaactatatctaaaataaataaatagttatttactataaataataaagaatacttagtataaaaagctttagaagctatatttaaggaaataatatatactaagatctagataaatattattcctagcttagaaaaattataatagaaagtaaaaataatacttattaagaaaatctataaatatttactcttagaatattaaaaagttaaaaaaatatttaatagaattaaataatattataattatttagatctataaaaagaagtataaactatagtttcagaatataatatatatatataaattaaatctatataatataaactgttctccatgagccccccttaggacacctgcgttatggtttaacagatgtgccgccccagccaaactccccacctgacaagttctccatgagccccccttaggacacctgcgttatggtttaacagatgtgccgccccagccaaactccccacctgacactgtcttcaacccgggtcggcccgcgaaggaccttaaaaccagaagttggacgtaaatccagccccgcttcattgaataaacacacaacacacgccacctaacctatactttacataacctatactcaacataacctacactttacataacctatactccacataacctacactttacataacctgcacctcacatgacctacactttacataacctgcacctcacataacctgcaccctaattagacagtcagattccccttgtccgtaccagttctaagttggttgttaaccgtacgccggacggccgaagcctgctagcattatcatgcataaagatatcccctggactaacaatatcaggcaatatagctgaatatagatcaacaatatgctggctattgacccggccgtcaagagctatcagcccggaacgcctctgatgacacaccacaaaaggtgttagtacatccagacagttggacggtggccatggaagtcggaatccgctaaggactgtgtaacaaacaccacaaaaggtgttagtacatccagacagttggacggtggccatggaagtcggaatccgctaaggactgtgtaacacctcaccaaccgaatgtactagccctgaaaatggatggcgctcaagcgtctcacccatacctcgccctcagggtagaaactggccatcgcaatgctatgttttaattagacagtcagattccccttgtccgtaccagttctaagttggttgttaaccgtacgcttagctgtgcgaaacggtcctgtaagcagtagagtagccttgttgttacgatctgctgagggtaagccgtccttcgccgcgatttccccaatacaggcggccctggtggctggctgcgtagggggtttgggagatggattacaaggacgccagagttccgacttagctgtgcgaaacggtcctgtaagcagtagagtagccttgttgttacgatctgctgagggtaagccgtccttctcctagaactctgcctggggcccccgccgtcgtctccgcgttcagttgcgttgccgcgcaaaacccacatccaggtgccggaatgttggtgagttgttacacagtccttagcggattccgacttccatggccaccgtccaactgtctggatgtactaacacctgttgtggtgtctgatgagcgtctactctggcaccttaacctcgcgttcggttcatcccgcatcgccagttctgcttaccaagttcgccgggtatagggtagctggttgtggtttctgcctacccggtaccccaacttcaaaccggtctcccgccttccacgcgttgctcgaatacattagcatggaataataaaataggacgtgtggttctattttgttggtttctaggaccgccgtaatgagtaatagggacagtcgggggcatcagtattcaattgtcagaggtgaaattcttggatttattgaagactaactactgcgactatatactacctctaactatatactaactctaaatactctctaactctaaccctaagtaaccctaatactccctccccctaaccctatactgaactgcaaatacaaggccttgccgtagagatccgatggatcccagcccacaaggggatagatggcaatgaactggctgattgcgcggcttcttgaaacacggaccaaggagtcgtcttcgtatgcgagtgttcgggtgtcaaacccctacgcgtaatgaaagtgaacgttgatacacttaaccggctagtagcagccgcaaaggaagcttggcatgctattgaagattatatacaccaaagcctgattaactcactgcctcgcagagtagctgcaatcatagaagcccacggctggtatacaaaataattagaaagtttattagatagaaaaattaaattaaataaaattaatttaataatatttagaattataatagattaattagttattactatagaatctttaagagaaaagtaatagctaatccctgttgcctgcctagccctggcacatacatcacacgctgcctcacctgcctcgcatggccctggccctgacccatccctcaccggtttggtggccgtgagtcgatttttttgatttcccatacaaatgaattttgcggaaaatcaaaagtggcccgggaaccgaaatccatccgagaacatcaggatcggtcggagatgcgccgaagctctctcctacgttcactttcattacgcgtagggggttgacacccgaacactcgcatacgaagacgactccttggtccgtgtttcaagacgggtcgttgatgaccattacgccagaaatccatccgagaacatcaggatcggtcggagatgcgccgaagctctctcctacgttcactttcattacgcgtaggggcttgacacccgaacactcgcatacgaagacgactccttggtccgtgtttcaagacgggtcgttgatgaccattacgccagaaagtaagttaacagtccagcctaaagagcgcagttactaggtgacaatgaccttgaaactcaaccgctgcgcctagcacacgcaggtttggcggcgaggaatgtgttgaaccggtgaggaatgtcaagattacccaggcctttcggccaagggagtactcgctggctccgtcagtgtagcgcgcgtgcggcccagaacatctacgggcatcacagacctgttattgcctcaaacttccatcggcttgagccgatagtccctctaagaagccagcgtactgccatgccacttttggtttagattttttgagtgaaaaccaacttcggggttctacccaaaagcatattagatcgagcaaggtaaaggagggctataaaatccctctgcatgcatgaccttttgatcgcgcattctgttgcagctgaacttctccacaattgtaaaccccaaaatgtttcacattgggatcattcaatggctaaaagggcggtgaataaagatttttccctttcaagtttgcgtgaaattagttggaatcaatatatgcgggcgatgtaaaactagggggtactacggaaaggagcatcagaaagtgggctggattgccgtgcgcggcgtcggtggccctgccgctggtgctgtgttcggcgcgctctcacgagtgccattcagtaactaattattgccgtgcgcggcgtcggtggccctgccgctggtgctgtgttcggcgcgctctcacgagtgccattcagtaactaatcctccagtgcccctcgtgggcgctggtggccaaccccggcgaacgatagttacctggttgattctgccagtagtcatatgattgccgtgcgcggcgtcggtggccctgccgctggtgctgtgttcggcgcgctctcacgagtgccattcagtaactaatgctccagtgcccctcgtgggcgctggtggccaaccccggcgaacgatagttacctggttgattctgccagtagtcatatgactttaatatacgctattggagctggaattaccgcggctgctggcaccagacttgccctccaattgttcctcgttaagggactttaatatacgctattggagctggaattaccgcggctgctggcaccagacttgccctccaattgttcctcgttaaggtatttaaattgtactcattccaattacaagatccaaaagaaccctgtatcagtatttattgtcactacctccccgagtcgtctttattgggcgtggtttgtcactttttggaattttcgaccagaaaatggaaaggtactacatagcacacccagacactgatcgggagtaatagagagctgactggtgtactcgaagatgtgggcaactgtctccttgccctggacgtccttcttgaccacaccatcctggtaaataccaattgttgcgagcacatcaaggacgttcttgtcggccttgtcaataccatcgaaaaccaaacaaacgacgatcttctgccatgctggaccacccttgtacataagcaactggaagtcagccatagcgtgtatcaccccgctaaaattccaaccccagcgcacccaacccactacataaacataagcaactggaagtcagccatagcgtgtatcaccccgctaaaattccaaccccagcgcacccaacccactacatactcaaccacagcgcacccacaccaccacaaatccaaccacagcgaatgcacgccactgtaaattccaccacagcgtgcatcgccgaacacagcaccagcggcagggccaccgacgccgcgcacggcaatccaccttccccctctcagttccccagggcatccttccgccgaacacagcaccagcggcagggccaccgacgccgcgcacggcaatccaccttccccctctcagttccccagggcagccttccaccacaccaagaccactagggccggtgcggcttgggcgccccaagaggagtgctcagcgcacagcttcaaccaattcagatcgtgccaaacatacagccgatggtgaagcgtctggaccattacgttcgtggtaagacctggattgcaacacccatggcagatcaggagctcaagaaacgcggcgtcgaagggagcaactttgcgttttctccagatgaaatcaaggacttgctgggctcttccggccattaaaccctagctccggacaaaccgatttcagggtgatagaccgttaagaagaaaagagaacagtttcgccgtataattgcttatacttagacatgcatggcttaatctttgagacaagcatatgactactggcagaatcaaccattaaaacgagcggggtcaaatcctttgcagacgacttagctgtgcgaaacggtcctgtaagcagtagagtagccttgttgttacagtgagaaggccagtatttcaaagagctcgcgaagctgattattctgaccaccacttcaaaaaaagtcatgtatatcgggcgcgcggtttggtggccgtgagtcgatttttttgatttcccatacaaatgaattttgcggaaaatcaaaaggcgtctgacgctggtcgtgcctctgacttggccgttgagcctctcggagactccgccgccatcgactgggtttgagggacgtccttctcccctctggttgtgatttctgtatgacgtgagttgaatgacccctccacaatcgataagcgctcactgaggatgtgggggggagtggcaaatgcatcgtgaccatggacaagtatcgtacttaatctccccaagggaaactacatatatttgcttttgtgtatattaaaccgttggcgtttaccgttatacagaccaacgggcgtggcggcagcaggtttgcgatagcttctttgcagcttatgcctctgacggcagctcaagaaagctgtttaaaactggggacgaaaataagcctgtatcacagcataatcatgtcaatattaaatagaatatttaaattaaactctagaataatacttataagtatatattaactataaatagaataattagatataactattactaatagtataaagaggtcggagaagccaacccctccctgatttcatctccgcttcccagatcccagtcgccaaggcataagacaaggcaaactcacctcttgtcctcacgccgcaagcttgaccttaacctgctaactagcccgtattgctttggcagtacgctggcttcttagagggactatcggctcaagccgatgggagtttgaggcaataacaggtctgtgatgcccttagatgttctgggccgcacgcgcgctacactgacggagccagcgagtgaaatctcttcaactgtaccgtatcttgcagattcccactgagtggtcacttggacaggctagacggcttcggcttcgcgggcgggtgattcatagtgggcgtcgaccctcacgaaagcggccgcgtgcggtacgtcgtactgaggatgcctggtctgggttggacaggggcgatgtcctgcgacagcctcggacttttctcggggcggtgaggtctcgtggctggcggagtcagaagtccccctggttgtgcgtcgtcccgagggcgctttcgggaaggcggagctcctggaacagcggatagcggagcttgagggagatcgcttccgaacaccaggggcggagtctgatggcgaccctcctccacacacacagccctgtgtgagctcacagagagccgctgagcccccggcactcacggcaccgagacccctttgtgggcagcagcccaagccacccttgcgaagattgggcctaggaagctcaaattcatcgatagtgatggaattgaacattattactcgtggatgatgatatctcgaagggtgagtaaaactctattacctgttattcctcaaacagacactactgtatattttggggcagatcatgggaccctacttatacagcacggcttctgcagaaagaagggctatattactagtgttgccagcaaccgtccgtggcaatagatcctcatcttctgcggtctaaatgtttgctgagacgtctgaaagcatgaaagccgaggcaagctatccaggtgctgtaccccctccgcctggtgatataccggatctcggcaatccacaagatgctggtcgcacgttaggccttgccgtgcttattggatgcgatatacttatgacaatattctttgctatacgtgcatacgtgaaagtccgggtgacttgtgaaatcctcctcgaagatggtatgtagaattatatggcacctatgtttgactcctctaactaactacctattactaaagtaatgtgtataatagcttgggtatgacccattatcttgatcataacttttatatatttacaaataataaaggttttaattctactatactctgctactttcttccttgtaggtttgagctctttggctactctgaaaggtttatagtaagctaaattcaataactagtgattcattatggggtagggtatcacgcatgggaagtagcgccagagaattactcacaggttctaaaggtaacgtgggtgcatagcgagctggacagcatagcgagctggacatttggcactgggctcagttgcctcgtggcctgtcgatggatcctttatggctggcgtggttgtaggtgctggggcctccttgttaatgtaagtcccacatttcgattctaactatacacttagaaggttgctggtggttagccagcagttcagatttcaagcatcagctatgttcaatagcaaggccacgacgcaatggagaaagacggagagcgccaacggcgtccatctcgaaggagtcgccagcgataaccggagaccgttaagaagaaaagagaactctgcctggggcccccgccgtcgtctccgcgttcagttgcgttgccgcgcaaaacccccatccaggtgccggaatattgaccggcttccctttcgccacacggcgcaaagtgcgcctttgaaacggaacttccctatatgtagtgggttgggtgcgctggggttggaattttagcggggtgatacacgctatggctgacttccagttgcttatgtagactctcttttctcaacttgatttctcatctgttgaccatgcatagggccgccgtatcgcctatctctttggatctgtcgccctggccggtatgtttggtggtctatttgcgacgggcattacttcaccacatgcacctcactgggaatgccaccaaagcatattcacacacaacacacgccacctaacctatactttacataacctcttccaagcgatttgattgacctaagaatctgttagtaggggatttcctaggtaattcctttctagcttgatcaaccttattatccggtgttggaactgtctctatttgaccccagatccaacgcagcttgccgtttgtatcatccttctttagctgtacgagccgttttgagtataggttatgtaaagtataggttaggtggcgtgtgttgtgtgtgaatatgctttggtggcattcccagtgaggggcatgtgctgaagtttggttcccggcgatgtgcatgtgctgtggttggatttgtggtggtgcatgcacgctgtggtggaagctgtagatgagtgtatccagcactttgaaggaagaacccttgagaaggttgttatcccttccaaacctacgcctgaagggttcaaaatctgggctgtggcaccagttctcaagataatattaggcagctaggataataaaaggagggatagcccagccagctgtatttaccccttggatcacagttgcctactcccggttaacgcccgagtcagcgatcacgaaggggttccaggacttcatccggcggctacaggcacggcagctgctggaccgggtggttatggacgaacgcccgagtcagcgatcacgaaggggttccaggacttcatccggcggctacaggcacggcagctgctggaccgggtgggtatggacgagtgccacgtggttctggacggagtcgggcggttccggccagcgttggcagcactgggggggatcttgcagttttgattttccgcaaaattcatttgtatgggaaataaaaaaaatcgactcacggccaccaaaccgcgcgaccgatatacatgacttttgtaaacccgccatcccatctcttctaaagggcgaagatagagatgatggcggtgatgcgcattttgaagaattgaaggtgaagttagtgtttttgtgatttaagactaagtaataaggtggagaaagatcaaataagaaggagttagaagaaagtagttagtaaaaaatggggttttaatgctgctggatttaaggggagaatacagctttacatattttcatctctagtctcctcctaagtagagatctaaacataggtactccttcctaatataaaagtataggtaaataaaacaatacctctgtagccttctcatttatcttccattcacgcacaactcgcccaagcgtcaccgccagattttccccgctgtgacacccgagctggcgtcgaagtactagtagacgcgactggtgcttgcctacgcggtcaagaaaatgagctgtaaccgccatgacagcgtgccgattgggtgactttttaaattaaataaatatttattttaattagtattattaaatagaaaagaattaaatagaatagaattattagaaagtttattaaagtaggcattatggtaatgctcttcaggttgcttcagcaaatgggcatctagagatcgctgggttgcttattgagaagggtgctgatatcaatattaagactaactactgcgaaagcatttgccaaggatgttttcattaatcaggaacgaaagttaggggatcgaagacgatcaaaaattcatttgtatgggaaatcaaaaaaatcgactcacggccaccaaaccgcgcgaccgatatacatgactttttttgcagtggtggtcagaataatcagcttcgcgagctctttgaaatactggccttctcacttccctccgatccgcgtggaaggctttcaaaggcgcactttgcgccgtgtggcgaaagggaagccggtcaatattccggcacctggatgtgggttttgcgcgggaacgcaactgaacgcggagacgacggcgggggccccaggcagagttctcttttcttcttaacggtctatcaccctgaaatggccctctgatagtcatatttccgaacccagcgcgtacgaagctctggttgccgcttgataaagttggaagcccaattgattgattttccgcaaaattcatttgtatgggaaatcaaaaaaatcgactcacggccaccaaaccgcgcgaccgatatacaggacttttgggccggtgtatttctgaagagtacccaggctcatgggagggcgtcccgcgggcgctgcagggtatgtaaaatcaaaaaggttgttaagagccgcggtaaattattgttttagagggtgggaagcgctgtaagtcgaggacagtggctagatacagggattcctgccaccaatagtgtgtcttgaagggtggctgcattatgtataagacgagagagactgcgaccttgattagttaatgagaaaacttgtctcatttctacttcagtgtctaacttaccagcctgtctccaaccctttagggcaggtttcgaagtcgtctgaggtcaaccttggaaagttgggggtttaacggcaggggctcgtcgctctccgatgcggaatatcactacttcgcacaggaggccacgacgggtcacgtcgtccatatcggcgttgggcgtggtttgtgcgccaccctgtggacctgtctcaatctcatctagcatccggagatggagcatctccatcgatgccagaaccaagagagccgttgttgaaagtttttatttatttgtaaaaactactcagaagattccaaaataaaacaagaattaagtttcctaggcgggttttgcgcggcaacgcaactgaacgcggagacgacggcgggggccccaggcagagttctcttttcttcttaacggtctaaagagggtaaatgtgggccggtgtatttctgaagagtacccaggctcatgggagggcgtcccgcgggcgctgcagggtatgtaaaataattaagtttattatacgagggataggtaaaagtggccgactcacttgtgtggccgactcacctgtggattacgttaactagacctgacgtggagcgtttcagcaccctcccctccaacttatcgcagaccaactctttataagattttgagacagtagcccttaattagtttagttttataggcaaaaccttgtgatctacattgttctatcaaccagaggctgttcaccttggagacctgctgcggttatgagtacgacctggcgtgagaattaatctacattgttctatcaaccagaggctgttcaccttggagacctgctgcggttatgagtacgacctggcgtgagaattcttccttcccgcggattttcaagggacgtcgagagcgcaccagacccagcagaggtgctgggctcttccggccattaaacccgggttatgtccaaggcctaagaaacagaaagtcttttttttaaaggtttgcaaaccttttactctattaaatcttgctatattttagagatagaaagttttgatagtgtaagaggtatagagaaattcgaaaagctagtgtagaggctggatctgccgctatccatagtttaaacctcttatttgcgcggcaacgcaactgaacgcggagacgacggcgggggccccaggcagagttctcttttcttcttaacggtctatccagcgccggcgagagcagagctctccccagaccaggcatcctcagtacgacgtaccgcacgcggccgctttcgtgaggggcgacgcccactatgaatcacccgccagcgaagccgaagccgtctagcctgtccaagtgaccactcagtgggaatctgcacagcgccggcgagagcagagctctccccagaccaggcatcctcagtacgacgtaccgcacgcggccgctttcgtgagggccgacgcccactatgaatcacccgccagcgaagccgaagccgtctagcctgtccaagtgaccactcagtgggaatctgcactgatcctattgaacacacggctcgaaggaagaggatgacctcggtcatccggatatgaatatccctagttattactagccagagggatatcggaaggcaggcctttgctcgaatacattagcatggaataataaaataggacgtgtggttctattttgttggtttctaggaccgtcgtaatgattaatagggacagtcgggggcatcagtattcaattgtcagaggtgaaattcttggatttattgaagactaaggcaggcctttgctcgaatacattagcatggaataataaaataggacgtgtggttctattttgttggtttctaggaccgacgtaatgattaatagggacagtcgggggcatcagtattcaattgtcagaggtgaaattcttggatttattgaagactaaatcgtctctggcagattggctacattgatgagggattccagcagggaaccagcctagcggttgaaccgtggtgggtggttgtgacggccacgagctacgtaggtggctacctgtggtgtcaattgtgagttgatgcctcggatataaaagtgtgaatattcgatacgtaccgcctcgtccatgcagactttgacgcaggcgtcgctttcccacgacttgtcggaacagtagccacgaaaaaggatacccttgttcaagcaaagtcccgaagaagaaaagagaactctgcctggggcccccgccgtcgtctccgcgttcagttgcgttgccgcgcaaaacccacatcccggtgccggaatattgaccggcttccctttcgccacacggcgcaaagtgcgcctttgaaacggaacttccctatggcttatagccagcggccatccatccacagaacccatccagcgccggcgagagcagagctctccccagaccaggcatcctcagtacgatggccggaagagcccagcacctctgctgggtctggtgcgctctcgacgtcccttgaaaatccgcgggaaggaataattcgtgttgtgtgtgaatatgctttggtggcattcccagtgaggtgcatgtgctgaagtttggttcccggcgatgtgcatgtgcgtattgttatggcgcataaaacttggctgacagtaacgtagaactgccttgttggcatgccaaaggcatagaagcgacaatgcagctgggaagcaatgagatactgcattcatgcaggcgagacagcggtctgtaaggatcacagatggcatccttgcaatgctttcgcagtagttagtcttcaataaatccaagaatttcacctctgacaattgaatactgatgcccccgactgtcactattaatcattacggcggtcctagaaaccaacaaaatagaaccacacgtcctattttattattccatgctaatgtattcgtcgtcatggtcctgcgcggcgtcctgcccaaccgcccgctcctctatggtctcttcggcaacatgtacctcgcgggtcatgtacctcgcgggtaccatcatctttggcggcggccccgtcgtgattccgctgctccgcgagtatattgtcgacgaagtgcctgtagccccaaccttcaaatctctcagaacactaaagaggtccgggcttgaaaagaggttatctaagaagatatgatatatggcaggaggcagccacatacgggctcatcaagggtttggccacgttaacaggccacaagccggatcccttccagcccgagcgaatattcgtatctgttagaccgatggctcctcctttgtgatatcgcctctgccactaccagtcgcagaaggagtttacatcatcgcggtaaatgccttgggcatggacggattatcagcagagggcagattaaaggccttagtcgaaggagacggaaaagcatttttgagccttttatccgggctaaggtagatgatacagctggtaagaacctgtggcattggggaaggttgcgaggtgtggctacgccggatggtcttgtgagagctatccctacttattttactagtaatccccttactaattgagtcccgggctgaagctcattccgtcatcagacggagctacatgccgaatagagatcgataatgttccctactgctccttctgccaaaaaccctatcacgtcgaaaccgagtgcttcaagagaaatccgaagctaaaagggaaagacgaaagagcacacgagtcgagtagtttgggaatgctgctctaaatgggaggtatacgtcttctaaagctaaataccggccagagaccgatagagcacaagtagagtgatcgaaagatgaaaagcactttgaaaagagggttaaaaagtacgtgaaattgttgaaagggaagctatgctttggtggcattcccagtgaggtgcatgtgctgaagtttggttcccggcgatgtgcatgtgctgtggttggatttgtggctaagaaggggagtggcaagagatctcttgatgagcgtggtgctggtatgtctgttgtcaaggctgctgccaagggtgctaagaaggggagtggcactaagaaggggagtggcaagagatctcttgatgagcgtggtgctggtatgtctgttgtcaaggctgctgccaagggtgccaagaaggggagtggaaagagatctcttgatgagcgtggtgctggtatgtctgttgtcaaggctgctgccaagggtactaaaactgtcgaagtgtacgtagctaaaagcactgggccctatgaggtaaatcctcccgggcgtaataaacttcattcaatcaccaacagcgagaacgaaatttttgaaaggacagcctcttgcagcacatcaaacctgtctcaaagggtcattagaggacctcgcttaccgggcatagctgcgtaattgcatagcggctaaaaccgagtaggatttaatcaatcaatcaatcaatcctaatctccttgtaagccggtcgggcgtagctaccccttttctttcgataaagaaccttacttcgctgcgtactgttcggagagctttccggccctgagtggtggtttccctcctctctgggccagtccggacgcctcactgagccattcaatcggtcgtagcgacgggcggaccccgctaaaattccaaccccagcgcacccaacccactacataatcaaccacagcgcacccacaccaccacaaatccaactggacgaggtaaagtagccagcttgcttctccttgatgtttccggggccttcgacaatgtgtcacataaacgcctccttcacaacttctgctatccacagtctacgagggcacagagtttacaacacgtatccggaagcggccgacaacaacacacgcccgggcacgggctatcaagcaattctttggtgctgagccggtaaaagaggccccagtcttgtctgcagctgctgattataattgaagaaggaccgtcacgcacctcgacatgttcatgggtcgacactcgcttattatacaccctcaaatgtcctctagacaatgatataccctcgtaagcgatgaaaccagctcagagcagctagtcatggtgacacagccatggagattggcaacatgacagggagtataggcatacacccctctggctctggtttccgtacctcgctccttacacgctccctgcccgggtggaggttggacgtgggttagtcgatcctaagccatagggaagttccgtttcaaaggcgcactttgcgccgtgtggcgaaaggtaagcatgcccctagggcgtggtgttggggatcggccaaagcccgcgagggacggccggcccctaaatctagtggcggacccgtccatgcccctagggcgtggtgttggggatcggccaaagcccgcgagggacggccggcccctaaatctagtggcggacccggcgtggcctcctctgcgaagtagtgatattccgcatcggagagcgacgagcccctgccgttaaacccccaactttccaagcatgcccctagggcgtggtgttggggatcggccaaagcccgcgagggacggccggcccctaaatctagtggcggacccgccgtggcctcctctgcagcccagcatcgcaaaagccggctacaaggccggacccctatccagtatctgtatcagcatttgaacaaggaagggttcgtctttaaggatcgttgtgatccttccggtcgacttatctcacttctcatcgcccagcagaggtgctgggctcttccggccattaaaccctagctccggacaaaccgatttcagggtgatagaccgttaagaagaaacattgttctatcaaccagaggctgttcaccttggagacctgctgcggttatgagtacgacctggcgtgagaattattccgtcccgcggattttcaagggacgtcgagagcgcaccagacccagcagaggtgctgggctcttccggccattaaaccctagcataacctacactttacataacctatactcaacataacctacactttacataacctgcacctcacatgacctacactttactcctctggcttcaccctatacaggcatagttcaccttctttcgggtccggccccgtatgctcttactcaaatccatccgcgaacatcaggatcggtcggagatgcgccgaagctctctcctacgttcactttcattacgcgtaggggtttgacacccgagagtcgatttttttgatttcccatacaaatgaattttgcggaaaatcaaaactggcccgggaactgaccgtggcgtgcacgagggtagaagggcatagggttccacagagggaaaggcccggccggaccagtacacgcggtgaggcggaccggccagccaggcccacggttcaactacgagctttttaaccacaacaactttaatatacgctattggagctggaattaccgcggctgctggcaccaggatgggtcagggccagggccatgcgaggcaggtgaggcagcgtgtgatgtatgtgccagggctaggcaggcaacagggttagggcgagattagataatctagaaatatataaggagtatatatataaggtcttaaaaaaactagaagatataaaactattagtagaactagagaaaagctatttctatatataagaagttaacttcttgccacggcggtggagcggatggaaacgatcaacgcgtacactctatcgccctggcaccggcgtctgcctgtggggcacgacaacgaccccgaggtggcaattaggttggctagaagaatggacggcatcctcgtggcgacgagccagtatacataagcaactggaagtcagccatagcgtgtatcaccccgctaaaattccaaccccagcgcacccaacccactacatgccctaggaaccctcaggggtccgggccaccagcagagctattattaggttatcgggcttatctagcccagataaggggctagaaaatccgggaaaaatcctaggatattctcagacgatggctggccggtccgcctcaccgcgtgtactggtccggccgggcctttccctctgtggaaccctatgcccttcactgggggtagcggggaaacaggacttttactttgaaaaaattagagtgctccaggcaggcctttgctcgaatacattagcatggattataatattttttatactatctattagtaatagaaggttagaaataataccttcctatagctatataaaaatatactatctagatatactagtaaggaaatattatactttataaataaactcaaagacctgcgattcggcctcgaaagcctcgaaatcttcgccgtagagaaacgcacgagcaaccaggttcaagatatgtccatagcagcgcatgcgtcgagcccgaatatccgccgagcccatttctgcgtcaaggtctccgtagaagttcacaaggcagttgtcgttcgggagggcatcggagcagcacttggatgtgagatgttccacagcaagatagggacacaggaggctaaggtggtacagctgcagcggtggaagaagcagggcaagctgattgtagcaacaaatgcgctagggatggggatcgacgtgccggatgtacgggtagtgctacacatagggctcccacgacagcttcataggtcattcaagtcaaaccagctactaagatggacatgaggtcctttaagaggatcttggcaagtggcccctcaatcagctctgtggctttgcaaccacgttgtgcatggaatgaaagagcctacattttaggacttttactttgaaaaaattagagtgctccaggcaggcctttgctcgaatacattagcatggaataataaaataggccgtgtggttctattttgttggtttctaggaccgccgtaatgattaatagggacagtcgggggcatcagtattcaattgtatcgtagcgttgaggaaggcccattgcctttcgatattgctggttagtcttcaagctacctcgaggcagcttgttatactacgccgtacgtgctgcaatgtatcgatggtatatagcacaaggatggtcataacgcatatctgactccgccgatggcgggtagcttaaagttagtccaccatccattagaaaatgtaaaaatagctgcacaattggggtatttcaacgggaaaagcttatacgctttcctcttaaagtattagcgatctcgtattgcgctgtagcagctgcattagcggtcctcgtgtccgctgtagcagctacattagcggtccgcgtgtccgctgtagcgcttgcattagcggacctcgtatccgctgtacgagaaccttagcacttagttagtgaacctcgtgggcgctggtggccaaccccggcgaacgatagttacctggttgattctgccagtagtcatatgcttgtctcaaagattaggccatgcatgtctaagtataagcaattatacggcgaaactgcgaatggctcattatataagttatcgtttatttgatagttttagtagcgtgaaaattcacccaccaaatttcaacggatcctactaggaaccgtcgtggcattaatgatagggtagatcttggcggcgtcaaatggtagcttgatcaggttgtagtactgggtgtagaccaggccggccttgcgctcgatcgttataatcagcagccacagacgcaacaggtgcctctttgactggctctgcaccaaaatatgtatggatagcctgtgcccgggcgtgtgttgttcgagcaatgtcttttgcgtgatttggtacagcatgcggtctttattgggcgtggtttgtcactttttggaattttcgaccagaaaacgagcaatgtcttttgcgtgatttggtacagcatgcggtctttattgggcgtggtttgtcactttttggaattttcgacaacgtactaagctcaattaccattgcggcgaggtcatcagtagggtaaaactaacctgtctcacgacggtctaaacccagcgcacgttccctattagtgggtgaacaatccaacgcttaccgaattctgcttcggtatgataggaagagccgacatcgaagcgtactaagctcaattaccattgcggcgaggtcatcagtagggtaaaactaacctgtctcacgacggtctaaacccagcccacgttccctattagtgggtgaacaatccaacgcttaccgaattctgcttcggtatgataggaagagccgacatcgaagactccaccaactaacaacggccatgcaccaccacccacaaaatcaagaaagagctctcaatctgtcaatcctcattgtgtctggacctggtgagctgccgccggccggttgcccggctagtggctgcctgctcccgaggcgtcctcccaaagcccaacgtacccaacccttagcgccaatccttatcccgaagttacggatctattttgccgacttcccttatctacattgttctatcaaccagaggctgttctgtacgaaggggagatcccccggcaaccccatatcagatggttgaggcgacaatgaggcaggtagaggggcatccgtggtaggcctaccataggagaaacctctctcataggtgcaccgacccacatttaccctcgtgcacgccacggtcggttcccgggccacttttgattttccgccaaattcattgtctccacacttagatcgtatcgataagctgtgtatttaactactggctggggggatgcagacaactgcctggttgagctgaggaagggagatagttagcaccaatattcaagataatgaacaccgaacatcagtcttgcagcagagaggaatctgcaagggttagtcttttatgcttgctagcatagcttgcgctagcgctacacaaaaataaatataaataaatatgaagaatattatggtctgctttatcttcagcaacagccgatatttgaatgaattcgttgaccttctgattccacttgaaccagtcattggcatttacagcgtgccgcgtatacgtcagcgagtgcggcagtagtgatctgggctgccgaggtcgggtggctcgtccagtcaatgctgtttacacaggccttcgtcagcttggttgtaaataccggccagagaccgatagcgcacaagtagagtgatcgaaagatgaaaagcactttgaaaagagggttaaaaagtacggagtgttcgggtgtcaaacccctacgcgtaatgaaagtgaacgtaggagagagcttcggcgcatctccgaccgatcctgctgttctcggatggatttgagtaagagcatacggggccggacccgaaagaaggtgaactatgcctgtatagggtgaagccgcgcaggctcttgtgttattacgcgaaattcaacgaataatacaactctcttctcctcgaataaccagctgtaggcggtatgttcattgaataatatgctgccgtcgaattgcttaggttctgaggcaatacaggtgaatgtgcccacctcagcccttggttggatatccgtcggatgaatcgtaggaaattattgacgattggaactgcctcttctggggtcttcgtagcccttgtgacccgtcttctcgagaggttatttcgtagcttaaagttagtccaccatccattagaaaatgtaaaaatagctgatgcctgcagacgcttgagagccatagtagctgggtatgctcagttgtgttctcagtggatggccagcaggttgcatcatgttcacatgataaaacaattcattgctgatcctctttgccccaccttctgccgcccaaaaatgggatccaagccaccttcttgtacctcagtcgctccgtattgtcactatggcaatcattcttttattcaaccacagcgcacccacaccaccacaaatccaaccacagcgaatgcacgccactgtaaattccaccacagcgtgcatgaagagtttggagagctttccggccctgagtggtggtttccctcctctctgggccagtccggacgcctcactgagccattcaatgccatcggatatctacagtcgtcacgtcatctaaaccggctttccggctgtagaaacgttcatattcctgccggaaagacgacggatgaacggcgtcgatgggcaagctcacattaggcgatatagccttcagggtagcttagaagagatgggatggcgggtttacaaaagtcatgtatatcggtcgcgcggttttcttgagaatccggttcgaatggaacgctttgcgaaggcaatgagcggatttgcagcaaacgaagacttcagtctgctcctcacaggctgcctccaccagagtttcctctggcttcaccctatacaggcatagttcaccttctttcgggtccggccccgtatgctcttactcagcctccaccagagtttcctctggcttcaccctatacaggcatagttcaccttctttcgggtccggccccgtatgctcttcctcaaatccatcctttgaaagggggtattgatgataataagtatttggtgggtattccatttgcttggaagcagggagggacggtttgctgataaaagattaaaatccagatggagcgtgtcattcagcttgcgatttcattgcccgacggctcagatatacaaactaagcttcccgagagacagaccgggcgccagaactctggcgtccttgtaatccatctcccaaaccccctacgcagccagccaccagggccgtttgagataagattctggcatatttgattgatttgtttggctgtttgtttgattgcatttgatttgtgggcagcgctgacgagaatcgtggtcgtaagtgtcggtggcgttgtgtcttggtacgtcggtcgaactcttccaatgccttgtgaataagcaactggaagtcagccatagcgtgtatcaccccgctaaaattccaaccccagcgcacccaacccactacataatcaaccccagcgcacccacaccaccacaaatccaaccacagcgaatgcacgccactgtaaattccaccacagcgtgcatgcaccacattctggaagcatttgatcataaattcatcggttgtatgacttccgtggccatcaaggataagcaacctaggtctcttagtctcatgttgaggtcgaatgagagatgctaagttttccatgataatcccacaccaacctgcaatgctgataatatttgtgctacatagaatctggatgccctcaataactaccgaaagtcagcatattttgctcaggggaaataatatgtatttacatcttatttacgtccctgccctttgtacacaccgcccgtcgctactaccgattgaatggctcagtgaggcgtccggactggcccagcgaggagggaaaccaccactcagggccggaaagctctccaaactcggtcatttagaggaagtaaaagtcgtaacaaggtccaccacctgctctacaggatgccggattagacactcaagcacacaacgtcactaggttcactagtaatggtgctcttctctatctagtcctcggcctcttccccgagcagtgcccaccagagatcaagatagacctaggtaaatttggtggcataacctttataacactcccgagggagccacattcccaaagcctttatcccccggggcgaactgatgctggcctgggcaggcagagtgcaccaccactgaaccatgcccgttttccgcggctagtaatagtggagtccaaccatcggcagtcatacattggatatcagctcctttctctaacgacattcgagctgcggccacttccccatggccggaccagtacacgcggtgaggcggaccggccagccaggcccaaggttcaactacgagctttttaaccacaacaactttaatataagataattagtctctaagttaataattctattattatacttaaattttaagccttctatattagctactatatagatttcttttttctttctctatagtaaatagagttagttaattattactagtaagatataattttcctatactctatagttaataaatactataagctagttccccttaggtccggccccgtatgctcttactcaaatccatccgagaacatcaggatcggtcggagatgcgccgaagctctctcctaggttcactttcattacgcgtaggggtttgacacccgaacactcgcatacgaagacgactccttggtccgtgtttcaagaccgatagaactgtcttgaggagtggctgtcgctgtacaaagcgagaggcccaattgatgccaacgcgctccgcgtcgcgggcgcgtagcagtaagttcgccatatctgccacctcgcgtaatcggggagaaaatgcttgggaatctagatcaagaatcctgtttacaaaagtcatgtatatcggtcgcgcggtttggtggccgtgagtcgatttttttgatttcccatacaaatgaattgtgcgggttacgacttttacttcctctaaatgaccgagtttggagagctttccggccctgagtggtggtttccctcctctctgggccagtatgagaatacgacgtcgcgagcttgagcattattaaccacatgtaggtctcacaggatcttcgagagcagtcaaggtgccgatacagacccgaacgaacttgctcgtcagtccagagctcctttctcccggccagaagagactgtatctggcaggcaaaggacacatcattgccgtaccgatcccagacgcagcggaatctctcgggcgaaagatgatggtacccgcgaggtacatgttgccgaagagaccgtagaggagcgggcggttgggcaggacgccgcgcaggaccatgacgacgataaaagtgatgaggaagaggccgatgaggaatatagcggtcgaaggttttggtggttgtgagttgattttttagatttcctatagtaatgaattttgcggaaaatcaaaagtggcaatatgctttggtggcattcccagtgaggtgcatgtgctgaagtttggttcccggcgatgtgcatgtgctgtggttggagttgtggtggtgcatgcacgctgtggtggaatttacagtggcgtgcattcgctgtggttggatttgtggtggtgtgggtggcgcgtggaaggcgggagaccggtttgaagttggggtaccgggtaggcagaaaccacaaccagctaccctatacccggcggcactttgatttctcgtaaggtgccgaacgagtcaatttttaacatcgtccgatccctagtcggcatagtttatggttaaatctcctctctcaatacggtcaaaaagcaagcctacggcagaggaaccacacgggagacataaatacgcctgttttacagcatattctagtttgggaatgctgctctaaatgggaggtatacgtcttctaaagctaaataccggccagagaccgatagcgcacaagttagtttgggaatgctgctctaaatgggaggtatacgtcttctaaagctaaataccggccagagaccgatagcgcacaaggagagtgatcgaaagatgaaaagcactttgaaaagagggttaaaaagtacgtgaaattgttgaaagggaagcgttcatgatttgcggaaaatcaaaactggcccgggaactgaccgtggcgtgcaagagggtaaatgtgggccggtgtatttctgaagagcacctcacatgacctacactttacataacctgcacctcacataacctgcaccccacaggctatctcaccgcctgtagctcggagccagcgagtactcccttggccgaaaggcctgggtaatcttgttaaactccgtcgtgctggggatagagcattgcacttattgctcttcaacgaggaatccctagtaagcgcaagtcatcagcttgcgttgattacgtccctgccctttgtacacattatggctggcgtggttgtaggtgctggggcctccttgttcctcgcccacttggcgagtttccaaagcgactctggggattcagatgctttctcgaccttctcctgatggtctttcctgtcgctggcgggtgattcatagtgggcgtcgaccctcacgaaagcggccgcgtgcggtacgtcgtactgaggatgcctgggctggggagagctctgctctcgccggcgctggatgggttctgtggatggatggccgctggctaaacttaccactgagcaatagttgcattggaggttagatgagccaaacgacgcattaacatagtattatatcgtctatgaagaggactatatgcttaattcatatgctcgtaacctttgactaaaatcgcactgccacaacatgctagagcggttagttgcggtacataccctcctcataatcaaccacagcgcacccacaccaccacaaatccaaccacagcgaatgcacgccactgtaaattccaccacagcgtccatgcaccaccacaaatccaaccacagcacatgcacatcgccgggaaccaaacttcagcacatgcacctcactgggaatgaagacggccattagctgtaccatactcaggcacacaaaaatactgatagcagtcggcgtgtgaatcattagccttgcgaccctcggcagcaagaaccatacgaccaatatcacgaaaatagtcacgcaaagcattgggtgttctatatgcgaactcaaacgattctaatgcttggtttgatatggagtacaatgttgaacaacatatgaaaagggcggaacagacatggaaagagtacggcatccaagcttgggaggttattaggcttacgtctggtttgcttcggtcctgcagtccataccgagagaccggcgcagggctgatgcctcgaagagcgttctgatcctattgaacacacggctcgaaggaagaggatgacctcggtcatccggatatggtcgatacgcctcctcctctgcctcctggatcttcaccctcaacaagaggtacaccgcctccgccgtcaactcctctagtaactcggtatccttctgtatctaccccaggaatgcctcgtgcgttcagccgatttgctatcgctatggacattacaagagcctaagaagcaaaggaacacttgccttgtgaaagaaagagcccgacacaagcacttatcttgcggaagattgaggctggcaagcactatcttgggggttatccttgtaggtatctctttaaggcaaaggaggaaagaagagtatatgggcataagcacctggcactggcactttacataacctgcacctcacataacctgcaccccacaggctatctcaccgcctgtagctcacgctcagtagaccgtccctccctgtatctagccactgtcctcgacttacagcgcttcccaccctctgcgggcaggcctgtctgagcgtcatttcaaccctcatgcccctagggcgtggtgttggggatcggccaaagcccgcgagggacggcccccgccttccacgcggatcggagggaagtgagaaggccagtatttcaaagagctcgcgaagctgattattctgaccaccacgcgtctcccaagtgattgcggcttacctggtacacggtccaccactcacaataattataggaaatatcatagggagccaagattcgttttgctgccggcgcccggcggactggccccttgagcgccgtcatgataagccggatacacctctactactggtgcaccttacatcatatgccgacgccactatcctatcgactaatttgccgcatgcagtcgcagatcagatgggttacgctagtattatcaaagcatgcgtgggcaattcgtctccacatgggcgtgtccagctttgtggcatagttggtgatgtaaaacaccatggccaggccctttgtcctcgtcaagatcatcgatatatcgtggttgtggcggagaccgaccgccatcgctttgttataccggttgacgagtgcctaacctatacccaggctaccctataaccagcctaccctagactaggtcttagatcttgaataattccttcagctttaagaatgcgtatctctcggaaaccactttcaaggttcttgcgccaattgtctctatcacacgtacggtgattgcgagtatcacttcctcgactacaagcccctagaaaccaacaaaatagaaccacacgtcctattttattattccatgctaatgtattcgagcaaaggcctgcctggagcgttattagttaatttatctctataagtataatatatatttactactataaaaggtttttattaggaataatatagatttaatgggaatgctgctctaaatgggaggtatacgtcttctaaagctaaataccggccagagaccgatagcgcacaagtagagggatcgaaagatgaaaagcactttgaaaagagggttaaaaagtacgtgaaattgttgaaagggaagcgttcatgaccagaaacagcaggaccgcaagaaagctccaaattatctctccagcccaagcttccaggtgccaaaacacaccgcgcccaattatgttggcttctcggattgctaaaattccaaccccagcgcacccaacccactacataatcaaccacagcgcacccacaccaccacaaatccaaccacagcctgggctatccctccttttatcatcctagctgcccaatatcatcttgagaactggtatcgggaatgcaatctgccgtacaattggcggcttgtaacaactgagaatagctggactactaataaggttggtctggattggattaagcactttaattcctatacagctcctcgtacgaagggggtattctccgaccgatcctgatgttctcggatggatttgagtaagagcatacggggccggacccgaaagaaggtgaactatgcctgtagttttaccctactgatgacctcgccgcaatggtaattgagcttagtacgagaggaaccgctcattcagataattggtgtttgcggctgtccgaccgggcagtgccgcgaagctaccatctgctggataatggctgaacgcctctaagtcagaatccaacgtacccaacccttagagccaatccttatcccgaagttacggatctattttgccgacttcccttatctacattgttctaacgtacccaacccttagagccaatccttatcccgaagttacggatctattttgccgacttcccttatctacattgttctctcaaccagaggctgttcaccttggagacctgctgcggttatgagtacgacctggcgtgagaattattccttcccgcggagccgatgcctatgccgacgcgtacgcttcttactacaagcgtgccaccgtcctccaggcccgtgctggttgcgtaagtttactcctagctcaaaccgtattcataaattacgctaaaacatcggcttgacaacgccgaggtatagggtaactcgctctgcagcaagcctcaaaccttgcctctatagaggttaaaattgctgtggagacagggattttgctgcgggacgatctttcccatgccatgcggaccgcaccctccgcattcgccccaccccttcacaaacatcctctccacatctcttcccactgtccctatctactatctagcgaaaccacagccaagggaacgggcttggcagaatcagcggggaaagaagaccagccccgcttcattgaataagtaaaaaaacaataggagtagtggtatttcaccggcgccgaagctcccacctattctacccctcctatgtcttttcacaatgtcaaactagagtcaagctcaacagggtcttctttccccgctgattctgccaagcccgggccagtagtgcgtgatgaaacaatgagataggatactgggctacaattcaactaccaaaggcatatatgtaatttcgatcgccatcctagttggagcacttgtgatttgaatgtagataagggaagtcggcaaaatagatccgtaacttcgggataaggattggctctaagggttgggtacgttgggcgttgggaggacgcctcgggagcaggcagccactagccgggcaaccggccggcggcagccagcacctgggtgctgatgcccttaaagtttgagaatggatgaaggcaatatatagcccccgggtccctaatcattcgctttacctcataaaactgagttcatagggacagtgggaatctcgttaatccattcatgcgcgtcactaattagatgacgaggcatttggctaccttaagagaggcatagttactcccgccgtttacccgcgcttggtcgaatggcttcgctttgacattcagagcactgggcagaaatcacatgactggaggctcttggcagaaatcaagcatatccttgagccgttccatctgcagaccatgagaacgcaggggtggggtagcgagggaggtaatggacgactttgggaggtgatggtgatggtgatgagaagctcggtttggcgattgtacatgcgagggcgcaaatcgtacccgttcttgagcgtaaagtcgttggggtcgcaggtcgcagctgtgtatcgcatcttcatgaactcctcctcggcaccttcaacgtcacggtatttcccttataaacccggtgttgcaatccctctgaagcccgaagttgatcaccgatatcaacaccacccatgttgtcattataatccgctgagaactgacgggatctgaaggaatttgaccggctttccgctaaattccctcttgatcgggcgtgcccttgctttcgtagtttttctgctcataggtaagtcctagagaaaattcaactgcataagcggaatttaaaaggggttttcgcagcctatgcgaggacaggctgccttttcattggttcaatcttacgaggtgagatgtttgctcatgggtctacgctaacggatattgcaccgggggagatacgagacaaagtgacacgaggtatatcggtcgcgcggtttggtggccgtgagtcgatttttttgatttcccatacaaatgaattttgcggaaaatcaaaccttcggcgcatctccgaccgatcctgatgttctcggatggatttgagtaagagcatacggggccggacccgaaagaaggggaactatgcctgtatagggtgaagccagaggaaactctggtggaggctcgcagcggttctgacgtgcaaatcgatcgtctgtaggcattgtaggctgaactgactgcagctgtgtgcttttcacccgacgtgaactcggctaagtaacggctgtagtcgcccttcctaaaaacagagcgagtcagctcaagcgctttcaagaagtgaagaccagtaaagtaggcatacatcgtgtaatataatcttttttttttttttttttttttttttttttttttttttttttttttttttttttttttttttttttttttttttttttttactctaagttgttggaggaagagatgaagggagagtaggggaaaaaccttatatcttgattttaccccactttttatataaaaatatattgagaaggttctccgttatcttgggcatgccattgcgcatggattgatctcggaaagggttgcatctgatctgctacccccctgcagcccctggatgagacaacctcgtactctcctccaattggaatgaggatacccggtctgcagagtgacggatgaggagccacaccaacacattcgaaagtgagctaatagtaaagacggctaggctatcacttccaaccaggtatatctcttgctcgggatcttaatttatatgggaaatcacactgaaaagagttattctaatactaaaactaatttaaattctctatatagtttatattatatagatttaatttatatatatatattatattctaaaactatagtctatatttcttttattaaaaaccaatgcccttcggggctctctggtgattcatgataacttctcgaatcgcatggccttgcgccggcgatggttcattcattaaaaaccaatgcccttcggggctctctggtgattcatgataacttctcgaatcgcatggccttgcgccggcgatgggtcattcaaatttcttccctatcaactttcgatgtttgggtattggccaaacatggttgcaacgggtaacggagggttaggctctgaatgtcaaagcgaagccattcgaccaagcgcgggtaaacggcgggagtaactatgactctcttaaggtagccacatgcctcgtcatctaattagtgacgcgcatgaatggattaacgagattcccactgtccctatctactatctagcgaaactaaatctatattattcctaataaaaaccttctatagtagtaaatatatactatacttataaagataaattaactaataatcttatataactaacttttcttatttctaaataagtggcggtgtacctcttgttgagggtgaagatccaggaggcagaggaggaggcgtatcgactctcatcgggcttccgggcgtaaggttgggtgagctacgaatactcaagcttcgctcgcggcctccaagtcttcctgttaaccattgctcaaagtcagaatcctcccaaagcccaacgtacccaacccttagagccaatccttatcccgaagttacggatctattttgccgacttcccttccgtcttgaaacacggaccaaggagtcgtcttcgtatgcgagtgttcgggtgtcaaacccctacgcgtaatgaaagtgaacgcaccagacttgccctccaattgttcctcgttaagggatttaaattgtactcattccaattacaagatccaaaagaaccatgtatcagtatttattgtcaatgtgcatgtgctgtggttggatttgtggtggtgcatgcacgctgtggtggaatttacagtggcgtgcattcgctgtgggtggatttgtggtggtgtgggtgcgctgtggttgattatgtagtgggttgggtgcgctggggttggaattttagcggggtctaccttaagagagtcatagttactcccgccgtttacccgcgcttggtcgaatggcttcgctttgacattcagagcacttggcagaaatcacattgcgtcaacaccactttctggccatcgcaatgctatgttttaattagacagtcagattccccttgcacacccagacactctcaccatgatcatgcaagcacccgtccagttacagggcacctaccctactaaaacaacccacaacagtatacataagcaactggaagtcagccatagcgtgtatatttgaccccgctcgttttaaaattacaatacgcgaaatactacagcacacttctagtaccgtagagtaatcgcctgctaatttgaccccgctcgttttaaaattacaatacgcgaaatactacagcacacttctagtaccgtagagtaatcgcctgctcatctctataagtatagtatatatttactactatagaaggtttttattaggaataatatagatttaatattaatctaatacctctagattggattaaacactttgatcaatctacaaagacgcgtgtgaagggcaaatatcgccttcttattctggatggccatgagagccaccactcaatggaatttgagtcctattgtcgagataatgacattaagactctctgtatgcctcctcactcctctctttttgtttaatattacataaaagcataaattttacaaagtagcgctagctaattatagtttaattatatttttataagaaatgatatagaataacataattatgcccaaggtgggattcgaactcacgacctaaacaacacatagcacacccagacactctcaccatgatcatgcaagcacccggccagttacagggcacctaccctactaaaacaacacgactggctctgcaccaaaatatgtatggatagcctgtgcccgggcgtgtgttgttgtcggccgcttccggatacgtgttataaactctgtgcccttatagactgtggatagcagcagcacaagcgcattatccttccaagcgatttgattgacctaagaccgcattcatcgctccagataacacagttccagtcaatatccttatactgttccgcccaggcaagacgcttagctgcatgctcccgcattcatcgctccagataacacagttccagtcaatatccttatactgttccgcccaggcaagacgcttagctgcatactctggaagaagaagcggtcttttgcgttgtagccacttacggcggttctcatcgcgaaggaaggctcgcaaggctccgggggcaatcccgccgaagcaacagtaggtatgttcacatgggtttgggagttgtaaactcggtaatgatccctccgctgtttcacacctcgccctcagggtagaaacgatgccctgaggagtaggcggacgtggaggtcagtgacgaagcctagggcgtgagcccatggttcgggagctgaggagcgcgggccagaatgggcaggtagcgatgccgtcgacctacgctgcgatagcggctaggggtatactgccatctagcatacataatatgcaaagtcatagagcaacgccggctcaagccctgcgcgagatcattgggcttccttcttgagaccgctcttacgaacaccttcttactgcagaagaatggccagccaaattggaagccgctccggaccttacacgagtggcgggagcagatttctggttagacagtcagattccccttgtccgtaccagttctaagttggttgttaaccgtacgccggacggccgaagcctgctaatggcatcagcacccaggtgctggctgccgccggccggttgccttttggtaagcagaactggcgatgcgggatgaaccgaacgcgaggttaaggtgccagagtagacgctcatcagacaccacaatatgaggtgcaaggaatagctttgaaggagattgagcgaagagacaaagaaaagattggagagtgaaaccaggtagaaaatagttatgccagccattcgcagtttcgccgtataattgcttatacttagacatgcatggcttaatctttgagacaagcatatgactactgagccattcgcagtttcgccgtataattgcttatacttagacatgcatggcttaatctttgagacaagcatatgactactcagccattcgcagtttcgccgtataattgcttatacttagacatgcatggcttaatctttgagacaagcatatgactacttgcagaatcaaccaggtaactatcggataattccttcagctttaaagataaggtatctaatatctatacttaactgatcagcttaagagcctctttcagataaaagtgggtcttacatggggaagtggccgcagctcgaatgtcgttagagaaaggagctgatatccaatgtatgactgccgatggttggactctactattactagccgcggaaaacgggcatggttcagtggtggagttattactcgcaaaggataatcttgacgcagactccccgcaaaattcatttgtatgggaaagcaaaaaaatcgactcacggccaccaaaccgcgcgaccgatatacatgactttttttgaagtggtggtcagaataatcagtgattgcaaatcattagtatgaggttcgattcctccatagtctttaatttcttattataataataaataatatttaataatattttaatttaaatatatagtataattaaaaattaaattaaataaaaattactaatgttataagaagagaaaatataactactacatccaaggaaggcagcaggcgcgcacattacccaatcccgactcggggaggtagtgacaataaatactgatacagggttcttttggatcttgtaattggaatgagccccctggagcccaagcactttgatttctcgtaaggtgccgaacgagtcaatttttaacatcgtccgatccctagtcggcatcagtcttggttcacgcatcaccgcgccaacatgtagagcttttcgactttcccaaagcattctactccaagaaagacggacagtatgattattatcgagtcttcgctgacgatgccacttatcatcacggtcatgatctgaccagatatcatggagccggcaatcaatgagccgtctgcttgatgacacgtataggtgcaagaaggatgaggtcaggcaggagctttcagatgcccttaaggtgaacagcctctggttgatagaacaatgtagataagggaagtcggcaaaatagatccgtaacttcgggataaggattggcaaggtgaacagcctctggttgatagaacaatgtagataagggaagtcggcaaaatagatccgtaacttcgggataaggagtggctctaagggttgggtacgttgggctttgggaggacgcctcgggagcaggcagccactagccgggcaaccggccggcgccgcaactgtggcatttttgagccttttatccgggctaaggtagatgatacagctggtaagaacctgtggcattggggaaggttgcgaggcagtgaggcgtccggactggcccagagaggagggaaaccaccactcagggccggaaagctctccaaactcggtcatttacaaagttaaaatggctacttctgggtctaagggaaaacaactcttagagggttcctataaggttccttctagtcctatagattctaataagaatctagaggctttagaggaagaagtagaaatttacagtggcgtgcattcgctgtggttggatttgtggtggtgtgggtgcgctgtggttgattatgtagtgggttgggggcgctggggttggaattttagcggggtgatacacgctatggctgacttccagttgcttatgtatactgttgtgggttgggcggaagaatattgcatactcagtggtaggactggaaagacagcagagcgggaggagcagcggcaaggaagacggcgatggtgaggtggccgggctcgaccagacgattgaatggctcagtgaggcgtccggactggcccagagaggagggaaaccaccactcagggccggaaagctctccaaacgcggtcatttagaggaagtaaaagtcgtaacaaggtctccgttggtgaaccagcggagggatcattaccgagtttacaactaattataatattatttaattctattaaatatttttttaactttttaatattctaagagtagatatttatagatttctttaataagtattattcttattttttattataattttcctaagcttagaatagtatttatttagactttaatatatattattttctattatatagtataaataactatatataaataggtattaagttaatattaaatctatattattcctaataaaaatcttctatagtagtaaatatatactatacttatagaagtaaattaactaataaccttatataactaacttttcttatttctaaataagtataattttagattaaactaaaataaacgcagagactagttgtatttaaaacattaaaagccaatgctttcaaagtcttaaaccctctcattcgtatgaaaaaaaaaataaaggtttctcatgtttatattatctattcccttttagtctgaaagatgtttatcatattctataattactaaaaaatcaactcacaactactaaaaccttcgaccgatatatatagcttttataagacctacttttatctgaaagaggctcttaagctgatcagttgagtactgttcaacgtaggtgaaagctgcctcggctagccactgtttgaacggcttattgactgctgtatcgagaggttgaagaaggcttgtacaaccgggcgggatcagggctgttgtaatcttacgagatcgaacaatccaacgcttaccgaattctgcttcggtatgataggaagagccgacatcgaaggatcaaaaagcgacgtcgctatgagctgcaagagctgttgcaaggagccctcttcaaagctagctcaataacctacttttttggccggaagcccgtaattcgtatagctagcccataattttgctagggattcatatataaattcctggaatagtaacaaaggcgtcaaaggcagctcttgaatctgtggtttgcgagcgacgaagcgggctatttgaatcggggtcgagccggacgaatacatcgcgatgattttatcttcgtatcgcaaaatcatctcttttcggaacttcgggaaagcgacctttggagcgaagggatggttgtgatcggtggtctggccaggttcgataatcagcattcccaaactactcgactcgtcgaaggagtttcacagaggctaggcatccaaccgtacggggctctcaccctctctggcgtcccgttccagggaactcggaaggcacgtcgccagaaacatcctctacaaattacaactcgggcttgcgccagacaacaatgaaatggcctgaagttttcaggagcttcaaagtcaactacattcaatctgcaaagcaaaagaaggctgcgccgcccaagtcggcgagattaacagacgtactgcactatgcttttcctgaagacgacctagaagagttccaagatgatattgctgagcttcgcggtcgccgacctcgcaagcgttcaccaatggacagtgacagaatcaaaaccataatggataagaagggcagagatcaggccgggcaactcacccgcggtcgccgacctcgcaagcgttcaccaatggacagtgacagcaggaaaaagggcgggtttgccctaggcatcggcaaacttacgcgtttcaacacaaaactcgcgttattgttgcgggcttctgtgtgaccctcatgagacgcttgagcgccatccattttcagggctagtacattcggttggtgagttgttacacagtccttagcggattccgacttccacagcttcaaccatggcggtgtccgctgcacgtggcgatctcccgttgctcagtggtaagtttagccagcggccatccataactatgactctcttaaggtagccaaatgcctcgtcatctaattagtgacgcgcatgaatggattaacgagattcccacggtccctatctactatctaggccgcacctgcctcgtaaggtatttgactctgttggcgataacaagcctcgaacaaggaagaggaagagagatgatgaacacagcctcaatccgacacaagctatggtaattagcctagtaaaacggctgccgccagccatttatcacgtcttaggggatcgaagacgatcagataccgtcgtagtcttaaccataaactatgccgactagggatcggacgatgttaaaaatggactcgttcggcaccttacgagaaatcaaagtgcccggattttctagacccttatctgggctagataagcccgataacctaataatagctctgctggtggcccggacccctggggagcttttataagacccacttttatctgaaagaggctcttaagctgatcagttgagtatagatattgaatatcttatctttaaagctgaaggttttgatttcccatacaaatgaattttgcggaaaatcaaaactggcccgggaactgaccgtggcgtgcaagagggtaaaggtgggccggtgtatttctgaagagtacccaggctcatgggagggcgtcccgcgggcgctgcagggtatgtaaaatcaaaaatgaaagtgaacgtaggagagagcttcggcgcatctccgaccgatcctgatgttctcggatggatttgagtaagagcagacggggccggacccgaaagaaggtgaactatgcctgtatagggtgaagccagaggaaactctggtggaggctcgcagcgtcggaccagcttgttacagttgacccgagacgctgtgagtggtttgctgcagcgccttaggctttcgccttcagcactcgctcattgctgatcctctttgccccaccttctgccgcccaaaaatgggatccaagccaccttcttgtacctcagtcgctccaatcattcttttattcctggtcaccaggtatgtatacatattggcattgaacaacagaccttttctttgggtgggtacctgggtgtagcggggaaacaggacttttactttgaaaaaattagagtgctccaggcaggcctttgctcgaatacattagcagtaatgattaatagggacagtcgggggcatcagtattcaattgtcagaggtgaaattcttggatttattgaagactaactactgcgacgtgcacgccacggtcggttcccgggccacttttgattttccgcaaaattcatttgtatgggaaatcaaaaaaatcgacgcacggccaccaaaccgcgcgaccgatagccagttttgattttccgcaaaattcatttgtatgggaaatcaaaaaaatcgactcacggccaccaaaccgcgcgaccgagcggaatatcactacttcgcagaggaggccacgacgggtccgccactagatttaggggccggccgtccctcgcgggctttggccggaacaaagcggcaatgagcacattaagcatatcagagtagcctcgactaaccagctcaagagcggcgatttgagcatcaagacagccaccaccgaggacatgcaaaccactcacagcgtctcgggtcaactgtaacaagctggtccgatccgctgtgggaaatctcttcaactgtaccgtctcttgcagattcccactgagtggtcacttggacaggctagacggcttcggcttcgctggcgggtgattcatagtgggcgctcctaggtcggtacttagtctacttcgaggtacttaagtatcggccattaatggatatttcaacatactgcaaatcaggggcaaagtacactaaggtagctttaaggtactccctcctcttaattatagacacaaagacaagacggaagggcaccaccaggggtggagcctgcggcttaatttgactcaacacggggaaactcaccaggtccagacacaaggaggattgacagattgagagctctttcttgattttgtgggtggtggctcagaggtgtgagctttttaagaggatctcatgcgagaacgatgaagcacaagaatatctcttggcgagtgagtcgacggcggagctcgaggtagtcatgaacaacgacacccgaccgatcctgatgttctcggatggatttgagtaagagcatacggggccggacccgaaagaaggtgaactatgcctgtatgttgttacgatctgctgagggtaagccgtccttcgcctcgatttccccaatacaggcggccctggtggctggctgcgtagggggataacactgaaggaaggtcatcttgctgattggcgatgaatcaattagaatatccttcttcgcaagctcctcgcgataggctctcttgacgcaaggccacgacgcaatggagaaagacggagagcgccaacggcgtccatctcgaaggagtcgccagcgataaccggagtagttgaaatggtaataagacgaccaatctgaccagcaaggaagccaagatgggaaaggtccgcaaaacccacatccaggtgccggaatattgaccggcttccctttcgccacacggcgcaaagtgcgcctttgaaacggcacttccctatggcttaggatcgactaacccacgtccaaccgctgttcacatggaacctttccccacttcggtccttcaacagtatacataagcaactggaagtcagccatagcgtgtatcaccccgctaaaattccaaccccagcgcacccaacccacgacataatcaaccacagcgcacccacaccaccacaaacagtatacataagcaactggaagtcagccatagcgtgtatcaccccgctaaaattccaaccccagcgcacccaacccaccacataatcaaccacagcgcacccacaccaccacaaatccaaccacagcgaatgcacgccactgtaaattccaccacagctactggcgggcgcaatgtgcgttcaaagattcgatgattcactgaattctgcaattcacattacttatcgcatttcgcttcgttcttcatcgatgccagaaccaagagatccgttgttgaaagtttttatttatttgtaaaaactactcagaagattccagtagtaaatatatactatacttatagagataaattaactaataatcttatataactaacttttcttatttctaaataagtgcttcaagttgtgcagattgagcggtatgaagttgaggccgcggtcatggtgttccatttgccacgtgagtctcttgttcaacttgttgataatcaaaactggcccgggaactgaccgtggcgtgcaagagggtaaatgtgggccggtgtatttctgaagagtacccaggctcatcaaccacagcgcacccacaccaccacaaatccaaccacagcgaatgcacgccactgtaaattccaccacagcgtgcatataagactaataccctgatctgaatataactaaaaataatataaagcttaaataattaatttttaagagctacctctactctaattaatcataaccgcagcaggtctccaaggtgaacagcctctggttgatagaacaatgtagataagggaagtcggcaaaatagagccgtaacttcgggataaggattggctctaagggttgggtacgttgggctttgggaggacgcctcgggagcaggcagccacagtgaggtgcatgtgctgaagtttggttcccggcgatgtgcatgtgctgtggttggatttgtggtggtgcatgcacgcggtggtggaatttacaatctaatttgcttcccgcctgggctattagttgtgaagttattcagggttgaagttgacctacaattgggcagaacacccacttctgtctctctccctgaccacgcgcaacttctggttgatagaacaatgtagataagggaagtcggcaaaatagatccgtaacttcgggataaggattggctctaagggatgggtacgttgggctttgggaggacgcctcgggagcaggcagccactagccgggcagttctatagtaggtccactctaaattcaactctactggctagagatgttagccgactgtcttgtagacatgttaactttgtgtctcttggaaccatgccatcccagttcccacccgagatgccgcctccaaagcccagcaagatagtcatctttcagggcttgacgcgcttctttagcaagtgcggaaattgcaactaacttgtcctttgacttggttagatgggtgcaagtgtatatctccacgacttgcttcctactcaacataacctacactttacataacctatactcaacataacctacactttacataacctgcacctcacatgacctacttcccgggccagttttgattttccgcaaaattcatttgtatgggaaatcaaaaaaatcgactcacggccaccaaaccgcgcttccatggccaccgtccaactgtctggatgtactaacaccttttgtggtgtctgatgagcgtctactctggcaccttaccctcgcgttcggttcatcccgcatcgccagttctgcttaccaaaaatggcccactagtattgatacattcgaatgctcaggttctgacgtgcaaatcgatcgtcaaatatgggcatgggggcgaaagactaatcgaaccttctagtagctggtttccggcgaagtttccctcaggatagcagtattgaactcagttttatgaggtaaagcgaatgattagggacccgggggctatataacaagcgagcgggccacttccatctattcctcgtacaataaagtcaattaaaataacaacagctaattatctataataataatactagaaattgatttatcagattcctctccagtgggcattgatatcagcgcccttctgaataagtatctgagcgatctctagatgtccttctgctgaagcagcctgaagagcatggccataagctccaccttgggcattaatatcagcgcccttctgaataagcatctcagcaatttctagatacctatatagttggcgtcccgttccagggaactcggaaggcacgtcgccagaaacatcctctacaaattacaactcgggcttgcgccagacttcaaatttgagccaaattttgtgctagtattcgtagttacgagcacttcatcctcgtcactggtttgcgagcacaaagaggctgtgctgatgtcagaaataaatctatatataagaatatattctaatctttagatataattatatactaatttagatttcttttattttaatatatagctagatattttattagagtcgatttttttgatttcccatacaaatgaattttgcggaaaatcaaaagtggcccgggaaccgaccgtggcgtgcaggagggtaaatgtgggtcggtgcacctatgagagaggggcgcgagtgctgaaggcgaaagcctaaggcgctgcagcaaaccctacatgcagcagatgtcatacattaggccatacaatggcctcaaaggcatgccccctgcgatacgaagagctcttgctgtcatcgggatcagtagcaccagcacagacgactaaagagatagtacctacaacagtagcaccagcagctatagagattacggcagcccaggttgcagaaggtcagatagagacaggccagacgctctcggcaatgctccatcacatagccaggttattgcgatagcctcaactttgctccctccgtcagaccctccaacgcgtctaggaaagcactggtgcccatatttgacgatcgatttgcacgtcagaaccgctgcgagcctccaccagagtttcctctggcttcaccctatacaggcaatttattactataggaaatctaaaaaattaacttataactactaaaacctttaactgatatatatagcttttataagatctacttttatctgaaagagactcttaagctgatcagttaagtatagatattagatatcttatctttaaagctaaaggaattatctaagatctaagacctagtctagggtaggccacatggaacctttccccacttcggtccttcaagttctcattgaagtatttgctactaccaccaagatctgcactagagcccgttcaacccgggctcacgccctaggcttcgtcactgacctccacgtccgcctactcctcagggcatcgtttctaccccccaaaccccctacgcagccagccaccagggccgcctgtattggggaaatcgaggcgaaggacggcttaccctcagcagctcgacattgctctatcaaattgggactgatattactgttgatgagtgtattcagggctttacaggtagatctaggcagacaacaactgtccctaataagccgactccaacaggcttcaagatatgggttctaggccaaagaggctatttcctccgctgggggggtttaacggcaggggctcgtcgctctccgatgcggaatatcactacttcgcagaggaggccacgacgggtccgccaccgacttacagcgcttcccaccctctaaaacaataatttaccgcggctcttaacaacttttttgattttacataccctgcagcgacttacagcgcttcccaccctctaaaacaataatttaccgcggctcttaacaacttttttgattttacataccctgccgcgcccgcgggacgccctcccatgagcctgggtactcttcagaaatacaccggcccacatttaccctcttgcacgccacggagacgtgactagtcaggaaaggagatagaaaacaagaattctttgatgcatgagaattttcagactggttagatttacatgactttatataatagggatttacgtccaacttctggttttaaggtccttcgcgggccgacccgggttgaagacattgtcaggtggggagtttgggtggggcggcacatctgttaaaccataacgcaggtgtcctaaggggggctcatggagaacagaaatctccagtagaacaatagcggacctcgtgtccgctgtagcgcttgcattagcggacctcgtgtccgctgtacgagaaccttagcacttagttagcgaacctcgtaaccactggtcggcatagtttatggttaagactacgacggtatctgatcgtcttcgatcccctaactttcgttcctgattaatgaaaccacccactaatagggaacgtgagctgggtttagaccgtcgtgagacaggttagttttaccctactgatgacctcgccgccatggtaattgagcttagtacgagaggaaccgctcattcagataattggtttttgcggctgtccgaccgggcagtgccgctgcaagatacggtacagttgaagagatttcccacagcggatcggaccagcttgttacagttgacccgagacgctgtgaggggtttgctgcagcgccttaggctttcgccttcagcactcgcgcccctctctcataggtgcaccgacccacatttaccctgcagttcaacttgctgagttggcttagttggtgggtggccacgggttgcaggttcatcctcttcttcttcttcttcttccttccactgctccaaagatattaatacctatacctaggctgaaagtataatatttaactttatcttatagtattaaaggttcagatataaactactaattatattcttaaaaaattccacagagggaaaggcccggccggaccagtacacgcggtgaggcggaccggccagccaggcccaaggttcaactacgacatcagcctgaacgtcttggctaccaacttcttcctcttcgcatgccactatggacttgaatcgcacgatcgtgcttggcatcagtaactaattctccagtgcccctcgtgggcgctggtggccaaccccggcgaacgatagttacctggttgattctgcgagtagtcaggctatatatttccttcatccattctcaaactttaaatatgtaagaagctcttgttgcttaattgaacgtgagcattcgaatgtatcaatacgggaaccaaacctcagcacatgcacctcactgggaatgccaccaaagcatattcacacacaacacacgccacctaacctatactttacatacctacttatattaaacaccaaacaccccgtctcataaaagcgaacgtcgcttcagccgccgaagataggacgttgcacagttgaagaataaccttcaagctagttcgctggctatgctacagtggggaatcaaaagttccggtcaattcctccacacccgcgcaacaacgcggttcgcgcgttgcaaccttccctctggcttcaccctatacaggcatagttcaccttctttcgggtccggccccgtatgctcttactcaaatccatccgagcacatcaggatcggtcggagatgcgccgaagctctctcctacgttcactttcattacgcgtaggggtttgacacccgaacccttggagacctgctgcggttatgagtacgacctggcgtgagaattattccttcccgcggattttcaagggacgtcgagagcgcccttggagacctgctgcggttatgagtacgacctggcgtgagaattattccttcccgcggattttcaagggacgtcgagcgcgcaccaccttggagacctgctgcggttatgagtacgacctggcgtgagaattattccttcccgcggattttcaagggacgtcgagggcgcaccagacccagcagaggtgctgggctcttccggccattaaaccctagctccggacaaaccgatttcagggtgatatgaagggtgccatcaggccggacactgaggcacgggatggggggaatgacacagaggtacaggagagcgagagggaggtagagatacaggatagcgaggatgagtggagctagtacgcattggtctcttgtacttgtgtaggcaggacatgacatgccagattagatatagattagaacttaattaaaaactaattatatagattatattatatatagcctgatcttaggatattacctcccctgtaactggccgggtgcttgcatgatcatggtgagagtgtctgggtgtgctatgtagtacctttccattttctggtggaaaattccaaaaagtgacaaaccacgcccaataaagaccgcatgctgtaccaaatcacgcaaaagacattgctcgatctagtagtatttaaattctttaaatatatatataatagctataaattctttattatagatagggtaattaagttctatactatatagtttctttaagaagaatactataaaaagtacgtgaaattgttgaaagggaagcgttcatgaccagacttgggcaggttgatcatccgtggttctccgcggggcactctgcctgcccaggccagcatcagttcgccccgggggataaaggctttgggaatgtggctccctcgggagtgttagatcctgtgagacctacatgtggtgaataatgctcaagctcgcgacgtcgtattctcatacttgcggaggtggtcagctactgaacttgtagcagcggcggcgaagaactcgggctggcccttcgcgtcgcacaaacgacaggcccagtaaggacacaacggaatatcgttagtgtcaacctcaacgagaaagaatccatggcgcttgatccagctctttcggcccttcgaacccggcgttgttgaacgagacccttctttccaagcgtttcttcaagattggggcaagctggttagatcacgagatgagggcacattcaacagccggctaactgactttattcgtcaacatccgaaaaaaccagtggattattgcttggatatgtggatttatccttggaaggatcgcttcgtcatctatctcgttaaccgtcatcgtcacctaggtcatgtgaccacatcgatcgtggagtccagtcaacagcagatgtgtcccatgttaatcggcagtatagtctggtatgggccgggtttgaatccagagctatgcacggatcgacttcattggtctagggtagcgagatcagccagtcacagcagactgctgcaactgagaaattactggcacgcatttgggtaaatgaaaaccaaagtgatgaaagaattgaagatgttgaaagggaagcgttcatgaccagacttgggcaggttgatcatccgtggttctccgcggtgcactctgcctgcccacgcccgcttggccgccacaagccagttatccctgtggtaacttttctggcacctctagcttcacacgtcgaaggactaaaggagcgataggccacactttcatggtttgtattcacactgaaaatcaaaatcaaggggacttttacccttttgttctactggacagcccaaaacatctgacgaacagccccttgccgccgtacttcctgtatatcgccctgaagcagctgatcctttggccttaagaaggtccagataggccgcttgcctcggccccttacgacaccgcattcatcgctccagataacacagttccagtcaaatgtttggccaatacccaaacatcgaaagttgatagggaagaaatttgaatgaaccatcgccggcgcaaggccatgcgagtcgagaagttatcatgaatcaccagagagccccgaagggcattggtttttaatctaataaatacatcccttccgaagtctgcagaagcatggccagccaaattggaagccgttacggaccttacacgagtggcgcgagcagatttctcgcgatctcctacgagaatacggccaaaaagggagcctacgaaagaagaatggtttcccagagcggtcagaaaatccttcgaactaggataaagtagaggatacagaatcatgcattggaacttacttgtagattcccgggccgattcgcactcatcgatgcattcatcaagcgctctggacacccgcacgtacagatggacaagaataggcttcggcttagcgtcttagcaggcgattactctacggtactagaagtgtgcggtagtatttcgcgtattccaggtaactatcgttcgccggggttggccaccagcgcccacgaggggcactggagaattagttactgaatggcactcgggagagcgcgccgaacacagcacatcggtagcggcggggaacgggctagctacaagcatacacaatccattgaaccaactcaaagcgccacccgcgcaaatgctccgtgagattatagtaaacatccgcaacccactcaccgtagcgagcctacgggcgatgaacccgcgtagtctaaagggtgattatctgatgctccttgcagaatagctcgaattctgttgagtggtggctttcgtgtccatccatgattagaagacgatatgctggttcaccaacggagaccttgttacgacttttacttcctctaaatgaccgagtttggagagctttccggccctgagtggtttaccctcgtgcacgccacggtcggttcccgggccacttttgattttccgcaaaattcatttgtatgggaaatcaaaaaactatatataaatagatattagattaatattaaatctatattatttctaataaaaaccttctatagtagtaaatatatactatacttatagagataaatagtggcccgggaagcagctttagcgggttttagagtagtttttagtcggtagacctatgagagaaattagtataattttttgatctctctcacaaaaataagattcttttgcgctatattttgcactatattaggtccctctagcactaaaactcactgggggcctctctcttttctgttatatcggggttggggggttgggggcctctctcttttctgttatatcggggttggggggttgggggcctctctcttttctgttatatcggggtcttatataactaacttttcttatttctaaataagtataattttagattaaattaaaataaactctaatatattaatactaaatctaactcaacataacctacactttacataacctatactcaacataacctacactttacataacctgcacctcacatgacctaccctttacatactaaagctaaataccggccagagaccgatagcgcacaagtagagtgatcgaaagatgaaaagcactttgaaaagagggtgaaaaagtacgtgaaattgttgaaagggaagcgttcatgaccagacttgggcaggttgatcatccgtggttctccgcggtaagtgctcaacttggttggcctggctgacacgttgaaggcagaatcaacgccattgcaagaactatgggatgcctcagagacaggtgaggtgcttgggcagtccgacttacccagcactttcggcgacaggtactctcaacctgccccatgagcctgggtactcttcagaaatacaccggcccacatttaccctcttgcacgccacggtcagttcccgggccagctttgattttccgcaaaattcatttgtatgggaaatcaaaaaaatcgactcacggccaccaaaccgcgcgaccgatatacctgaggtcaaccttggaaagttgggggtttaacggcaggggctcgtcgctctccgatgcggaatatcactacttcgcaggggaggccacgacgggtccgccactagatttaggggccggccgtccctcgcgggctttggccgatccccaacaccacgccgataatatagatatccctatgatcccgtggctcgatgccgaccaactcgacggatacaccctcctcgatagccacatttctcggttcttctctctcgatataaataaaggtatatcctaagatcaggtaatatataatctgatatatattttttaagaatataattagtagtctatatctaaacctttaaatgtcttcagggtttaaaaccttcccttctctgctcttcttctcttctatcgtctatccatatttccttcggtcacacagtctaatttggctgcgaacatgccgtttccattcactctgctatgtgaccttctcaaccgacttgaaagaaactacaagacctacactttacataacctgcacctcacatgacctacactttacataacctgcacctcacataacctgcaccccacagcctatctcaccgcctgtagctcacgctcagtagaccggccctccctgtatctagccactgtcctcgacttacagcgcttcctagtccagtctttctgtccagtgctagctcaacctcagggactacctcgaccccagggactacctcagcctcagggacaacctcctcagggaccacctcagcctctgcaaagacttcatgtctcatctggagccagtgtgcagacacagactcggccgcagatccagcctcaatccctggcttctgcctacccggtaccccaacttcaaaccggtctcccgccttccacgcggatcggagggaagtgagaaggccagtataagcccaacgtacccaacccttagagccaatccttatccctaagttacggatctattttgccgacttcccttatctacattgttctatcaaccagaggctgttcaccttggagacctgcttctcttttcttcttaacggtctatcaccctgaaatcggtttgtccggagctagggtttaatggccggaagagcccagcagcgttatagcgaacttccctgctgcgttatagcggtctcaaggcccaatacaccttgaaggccactgtaatttcaacatatctaaaagagactcttaagctgatcagttgagtatagatattgaatatcttatctttaaagctgaaggaattattcagttatagcgaacttccctgctgcgttatagcggtctcaaggcccaatacaccttgaaggccactgtaatttcaacaggtcttataaaagctatatatatcggtcgaaggttttggtggttgtgagttgattttttagatttcctatagtaatgaaaactatagtcttagaatataatatatatatataaattaaatctatataatataaactatatagagaacttaaactagttttaatattaaaatactttgctcgaatacattagcatggaataataaaataggacgtgtggttctattttgttggtttctaggaccgccgtaatgaggatcaccgctaggactttctgctcataggtaagtcctagacaaaattcaactgcataagcggaatttaaaaggggttttcgaccgaagtggggaaaggttccatgtgaacagcggttggacgtgggttagtcgatcctaagccatagggaagttccgtttgaaaggcgcactttgcgccgtgtggcgaaagggaagccggtcaatattccggcacctggatgtgggttttgcgcggcaacaggcgatatagccttcagggtagcttagaagagatgggatggcgggtttacaaaagtcatgtatatcggtcgcgcggtttggtggcaggcgatatagccttcagggtagcttagaagagatgggatggcgggtttacaaaagtcatgtatatcggtcgcgcggttgggtggccgtgagtcgatttttttgatttcccatacaaatgaattttgcggaaaatcaaaaccctccaccacccggttcggacagtggccgcatgagctatgcatgcatgacttgccacctcgcctgggagggtgcagggtctgtcataccgtctgagggttgctcacagtacacgccccaacggactcaatagaactttggtgtaaagcgggtgcgctggggttggaattttagcggggtgatacacgctatggctgacttccagttgcttatgtatactgttgtggggtgttttagtagggtaggtgccctgtaactggccgggtgcttgcatgatcatggtgagagtgtctgggtgtgctatgtagatgtactagccctgaaaatggatggcgctcaagcgtctcacccatacctcgccctcagggtagaaacgatgccctgaggagatgtactagccctgaaaatggatggcgctcaagcgtctcacccatacctcgccctcagggtagaaacgatgccctgaggcgtaggcggacttctagcctttagaaatcgacccttcactactatctaccatgtctccgtccgataaataccttggtcaatcttttctcggcgaagaacagctgcgagccatgatgtcttccagtgagcgcggaaaccagctactagaaggttcgattagtctttcgcccccatgcccatatttgacgatcgatttgcacgtcagaacctctattctacacctcctatgtcttttcacaatgtcaaactagagtcaagctcaacagggtcttctttccccgctgattctgacaagcccgttcccttgagccccccttaggacacctgcgttatggtttaacagatgtgccgccccagccaaactccccacctgacaatgtcttcaccccgggtcggcccgcgaaggaccttaaaaccagaagttggacgtaaatccagccccgcttcattgaataagtaaaaaaagaggataccgtaagttggaattctgaccgtggcattggtgccaagtcggtgttcccagtcttcagcaaactgtcttaatgcctccatgtcctcggtggtggctgtcttgatgctaagcaacaagagcttcttacatatttaaagtttgagaatggatgaaggcaatatatagcccccgggtccctaatcattcgctttaccagttagcaggttaaggtctcgttcgttatcgcaattaagcagacaaatcactccaccaactaagaacggccatgcaccaccggctcgaccccggagaaggagcctgagaaacggctactacatccaaggaaggcagcaggcgcgcaaattacccaatccctactcggggaggtagtgacaataaatactgatacagggttcttttggatcttgtaattggaatgagtacaatttaaatcctgggatggcgggtttacaaaagtcatgtatatcggtcgcgcggtttggtggccgtgagtcgatttttttgatttcccatccaaatgaattttgcggaaaatcaaaactggcccgggaacatatacccctccagttagttaagggcctgcttatagtaataaagctgcttttaatattatagatccagtagctatatctacttagtttattactttattatatacagagggaaaggcccggccggaccagtacacgcggtgaggcggaccggccagccaggcccaaggttcaactacgagctgtttaaccacaacaactttaatatacgctattggagctggaattaccgcggctgctggcaccagacttgccctccaattgtagaagagaattaaatagaatagaattattagaaagtttattagatagaaaagttaaattaaataaaattaatttaatagtacttccgtcaatttctttaagtttcagccttgcgaccatactccccctggagcccaagcactttgatttctcgtaaggtgccgaacgtggcgggcatgcctgtctgagcgtcatttcaaccctcatgcccctagggcgtggtgttggggatcggccaaagcccgcgcgggacggccggcccctaaatctagtggcggacccgtcgtggcctcctctgcgaagtagtgatattccgcatcggagagcgcacggcaatccaccttccccctctcagttccccagggcatccttccaccacaccaagaccactagggccggtgcggctggggcgccccaagaggagtgctcagcgcacagcttcaaccatggcggtgtccgctgcacgtggcgatctcccgttgctcacccgctgagtaatcagggtgtccaaatgcttatgagcgtaggtctgtatatctcgaggagcaataccagacgtcataagattaggccggcactgtcgactcaaaggtcttatattacacgatgtatgcctactttactggtcttcacttcttgaaagcgcttgagctgactcgctctgtttttaggagtcagacgggctcccagcactacctatccgagcaaaggttggagattgagttgcttcatccgcaatcatgtgaccggatcggttagcggccatgttttcttggggctggctgaggtctcgcttagtttcctactcgctggaaatgtcaactgtcggtacattcagtcgcaggttgcctgatggttcagaagaaaacccggagttgatgtttaccggaattcacggaacgagggtcttgtgggttgcccccccacaatggcttggtggcatcatgggtttccggaaatcaaaaaaatcgactcacggccaccaaaccgcgcgaccgatatacatgactttttttgaagtggtggtcagaatcatcagcttcgcgagctctttgaaatactggccttctcacttccctccgatccgcgtggaaggcgggagaccggtttgaatctcttttccagcctaccacgtcagtccacaaatgaccctctggcacaaccgactggcccatctgagcgatgcgaatttacggcggctgaagaagcaagctattagttctttagattttaatagtttaataatataattaaagaatattaattactatagttattctaatactaaaactggtttaagttctctatatagtttatattatatagatttaatttatatatatatattatattctaaaactatagtctatacgaaggtcatcttgctgattggtgatgaatcaattagaatatccttcttcgcaagctcctcgcgataggctctcttaaccggtgaaaaaactgatatatcaagcggctgtaatacatgcgatgaatgcgaaggtaagaaaagaaggaatatattgttttggaagcatttgattatgaattcatcggttatataacttccgtagccatcaaggataagtaacctaggtctcttagtctcaggcttcatcaacgggatgaagatcaggtcaagccatacaagagcgatctcgtcattcgtccagcctgttgcagaagctgtaaaaaaaaagtacgtgaaattgttgaaagggaagcgttcatgaccagacttgggcaggttgatcatccgtggttctccgcggtgccctctgcctgcccaggccagcatcagttcgccccgggggataaaggctttgggaatgtggctccctcgggagtgttataggaggagggtatgtaccgcaactaaccgctctagcatgttgtggcagtgcgattttagtcaaaggttacgagcatatgaaataagcatatagttgcccaggccagcatcagttcgccccgggggataaaggctttgggaatgtggctccctcgggagtgttatagcccactgggtaataccctggggtggactgaggttcgcgctctgcaaggatgctggcgtaatggtcatcaacgacccgtcttgaaacacccttctgccattgattcaggcttttaattttctaccatcaatcatcaaatattctaaatcatcaatttacttaacccccttttacttttatatattaaatcagatttctttccgattttcaaaatgcgttttattaagactatcatctctcttttctccttcactcatcttgttgctgctcgaggggaggcgggttctggcagccctggaagatatcatgagaggccggccgtacgttgttgcgagtgtcctgcccatggatgagagcgttagcctcggcaactagcgacgtgggatggtattgcggtcattacctgtccattaacacaagcgcggcccatatccgccacaaatgaattttgcggaaaatcaaaactggcccgggaactgaccgtggcgtgcaagagggtaaatgtgggccggtgtatacaaatgaattttgcggaaaatcaaaactggcccgggaactgaccgtggcgtgcaagagggtaaatgtgggccggtgtagttctgaagagtacccaggctcatgggagggcgtcccgcgggcgctgcagggtatgtaaaatcaacagaaacttggccggtgatagatggtgggagggagccaggagagatagttatgcatgaggagggtatgtaccgcaactaaccgctctagcatgttgtggcagtgcgattttagtcaaaggttacgagcatatgaaagccccgtcgcatcgacgatcttccagggcgccttgaaccgacaggccgtccgcctgtacttatctgcgtcccggcttgtgaggcccttcagggaatacttgatgcaggtgtaggtgtgggaatggacttggcagcagtacgcgatgaagttggactcggaaaataggacaagacaggaaagaacaaataagggtaaagcaaatgatgagagatagcaaaaggagacgtgactagtcaggaaaggagatagaaaacaagaattctttgatgcatgagaattttcagactggttagtctggttgatagaacaatgtagataagggaagtcggcaaaatagatccgtaacttcgggataaggattggctctaaggggtgggtacgttgggctttgggaggacgcctcgggagcaggcagccactagccgggcaaccggccggcggcagccagcaccacctcgaccactgcttgaagccgagcgatgcggatctggcactagagtgtgcattcgactccatcatggtggatgggtcgatgtacgacgaggagggaaatgtcaaatacgtcaaatcggtggtggacagagccaggggcaaggggatcacagttgaggctgagctggggaggatggctgccctttgtacacaccgcccgtcgctactaccgattgaatggctcagtgaggcgtccggactggcccagagaggagggatgcggtgaaggctaggacgacttgctcttacaggatgtcaaggcatatgatgctaatatatcacagtcagcttgaataagctctagtggtttatctctagtggttttctcatattgtgatcccttctctcatctatctcttgttccaaatagataaattatacattcgaatgctcacgttcaattaagcaacaagagcttcttacatatttaaagtttgagaatggatgaaggcaatatataatacattcgaatgctcacgttcaattaagcaacaagagcttcttacatatttaaagtttgagaatggatgaaggcaatagatagcccccgggcggatcgcttccctgtcgcaattgcatagtccggcaggtcccagctttatgccggccacgggtacaaacggaagaatctagctctcagaaatcacaaccagaggggagaaggacgtccctcagacccagtcgatgccattcgcagtttcgccgtataattgcttatacttagacatgcatggcttaatctttgagacaagcatatgactactggcagaatcagccattcgcagtttcgccgtataattgcttatacttagacatgcatggcttaatctttgagacaagcatatgactactgattgtcaggtggggagtttggctggggcggcacatctgttaaaccataacgcaggtgtcctaaggggggctcatggagaagagaaaccaccaactaagaacggccatgcaccaccacccacaaaatcaagaaagagctctcaatctgtcaatcctcattgtgtcttgacctggtatatatcaagcggctgtaatacgtgcgatgaatgcgaaggtaagaaaagaaggaatatatcgttttggaagcatttgattatgaattcatcggttgtatgacttccgtggccatcaaggataagtaacctaggtctcttggtctcgggcttcgtcaacgggatgaagatcacctctgttgcctagcagagtataaagtgatagaatgagggcgaggacaggtgtttattttcttcagtatctgttttaatgtgttatatattgagggaggtagaactcccctcactaggggtttctatttcggaatgatctaacctatacccagtctaccctataaccagcctaccctagactaggccttagatcttgaatagttccttcagctttaaagataagatatttaatatctatactcaactgatcagcttaagagtctcttttagataaaagtggtatatcggtcgcgcggtttggtggccgtgagtcgatttttttgatttcccatacaaatgaattttgcggaaaatcaaaaatggcccgggcttgtattgacgcgtactcaaggtgtataatttggttctatattggccgatcagcaacaacctcgatgagcacattgaagcagtttcttgagaccgtgaggcacctacggatcccccgggtccctaatcattcgctttacctcataacactgagttcaatactgctatcctgagggaaacttcggcggaaaccagctactagaaggttcgattagtctttcgccccctaaatctaatctaataaaactaatatcctaatctaaatataactaaaaataatctaaagtttaaataattaatttttaaaaactatctctattctaattaacttaatatagtatataatatattaaaactataaattatggccctcatttttaatcgatctggaccttgctatcaaagagcagcgagaaggtgtttcaggagcaaagggaaagaccggcacgagggcattcatggctattggtgcacttctaggcgagcaacattctttcatgcacgatctagagtcattcttctgggtattgtcgactcagtaggatatatcaaaatgtactggcttgacccatacaaggagatgattatcaaggcatgggtggataagcacatgcattttggtaatatagctacgtcgaggtaggcgcctctaagtcagaatccatgccagaaagcggtgataccacccgcacgtacagatggacaagaataggcttcggcttatcgtcttagcagaataattcactggagtatattggcagtggatgcctatgagagttcactcctctgcggcccagtatagggagaattggcgtgtggtagtcacaaaatctccccgatgtatcacatcgtacactatttcattggtcagttttacgaactgccaagccttcaacaccatttcgacaccattgctttttaaaagtcatgtatatcggtcgcgcgggttggtggccgtgagtcgatttttttgatttcccatacaaatgaattttgcggaaaatcaaaagtggcccgggaaccgacccactttctggccatcgcaatgctatgttttaattagacagtcagattccccttgtccgtaccagttctaagttggttgttactttgcagacgacttagctgtgcgaaacggtcctgtaagcagtagagtagccttgttgttacgatctgctgagggtaagctattcctacctgatctgaggtcaaccttggaaagttgggggtttaacggcaggggctcgtcgctctccgatgcggaatatcccgtaccaccgggacctccggtgtactggaagtgttgaccggccgagtcggggtccgttgcgtatctatccaggaacccgcacacaagttgaagagccaatgtctgcagagtgttgaggggcgacgtcgctatgaacgcttggccgccacaagccagttatccctgtggtaacttttctggcacctctagcttcacacgtgcgacgtcgctatgaacgcttggccgccacaagccagttatccctgtggtaacttttctggcacctctagcttcacacggcgaaggactaaaggatcgataggccacactttcatggtttgtattcacactgaaaatcaaaatcaaggggacttttaccgagaaccttacagcggttacgagcccgtattacagaaggcaacgtgttatcttcagggctccaaaagccctgaaacacctataagtacagggcttcctccctgctagatagaggttcttcaagccaccaattcactcttttatcaaccctaaccctaaccctaaccctaaccctaaccctaaccctaaccctaaccctaaccctaaccctaacccctaacccttgtactcgccataacgggttaacccctgggttacctgttgggcccgctttttacctttacttaacccctaaccctaaccctaaccctaaccctaaccctaaccctaaccctaaccctaaccctaaccctaaccctaacccctaaccctaaccctaaccctaaccctaaccctaaccctaaccctaaccctaaccctaaccctaaccctaaccctaacattcctacctgatctgaggtcaaccttggaaagttgggggtttaacggcaggggctcgtcgctctccgatgcggaatatcggttagtttatgcgagtaggcatgacccacatatcagcactcactcgctccagttcagattgcttgatttaaactaaattgctggggtgttaactcatggtgcttctccacaggcctgtcacatacaatgccaatcgcaagggcttgtagctcgggtacatccacccacacccatctatcccttctaatcgacggtctgtagattgaaggtacctctaatactattcaatggagtgcgaaaacgctaagaaagatccagcacacggtatagaccagggggtctgacatattcggcggtcgtcatcgagcgggaaggagagcgaaggtatgtccccacgtgagcccaaatgcaatatttacccatttttaattaattggttgagtaagaatagcaacggcgacgacctacttggttcattcaaatttcttccctatcaactttcgatgtttgggtattggccaaacatggttgcaacgggtaacggaggggtagggctcgaccccggagaaggagcctgagaaacggctactacatccaaggaaggcagcaggcgcgcaaattacccaatcacaccgcccgtcgctactaccgattgaatggctcagtgaggcgtccggactggcccagagaggagggaaaccaccactcacacaccgcccgtcgctactaccgattgaatggctcagtgaggcgtccggactggcccagagaggagggaaaccaccactaaggatcgactagacatccctctatcccagccacaatgtaccggaccccgagactgccaccaaccaggtgacaaacacgatgaggaaagacaggtgaggagagtcacagttctctgcctcaagaggcagtgtacacagagagctgcatgaagtcggttgtgatagcctaaggcgctgcagcaaaccactcacagcgtctcgggtcaactgtaacaagctggtccgatccgctgtgggaaatcgcttcaactgtaccgtatcttgcagattcccactgagtggtcacttggacaggctagacggcttcggcttcgctggcgggtctgctccaagcttcatcttacgagcctctatcacctgcaacccaagcttctctgcctcctcccaccggccttgattccaatatgttgatgcaattcaaaggtgttcatgcctctccctactgtctcccaacatggaatataccaaattggattctagagtttgtttgtccgccaatgggactttctcggcatgattatgctgtgatacaggcttattttcgtccccagttttaaacagctttcttgagctgccgtcagaggcgtaagctgcgaagaagctatcgcaaacctgctgccgccacgcccgttggtctgtataaggctgccaatttggctgcccacggagctgcacctatactttacataacctatactcaacataacctacactttacataacctatactcaacataacctacactttacataacctacaaccaccaaaccgttcgaccgatatatatagcctttttaagacccacttttatctgaaagaggctcttaagctgatcagttgagtatagatattagatacgataggccacactttcatggtttgtattcacactgaaaatcaaaatcaaggggacttttacccttttgttctactggatatttctgttctccatatcaaccaggtaactatcgttcgccggggttggccaccagcgcccacgaggggcactggagaattagttactgaatggccctcgtgagagcgcgccgaacacagcaccagcggcagggccaccgacgccgcgcacggcaatccaccttccccctctcagaaaaaaatcgactcacggccaccaaaccgcgcgaccgatatacatgacttttgtaaacccgccatcccatctcttctaagctaaaaaaatcgactcacggccaccaaaccgcgcgaccgatatacatgacttttgtaaacccgccatcccatctcttctaacctaccctcacggcgcaaagtgcgcctttgaaacggaacttccctatggcttaggatcgactaacccacgtccaaccgctgttcacatggcttttctggcacctctagcttcacacgtcgaaggactaaaggatcgataggccacactttcatggtttgtattcacactgaaaatcagtgtctcccaacgtctagaagacatctaacaccagtggaagttgctgaatgctagctgagctggaaaacaccggcgacagaaacttggccggtgatagatggtgggagggagccaggagagatagttatgcatgaggagggtatgtaccgcaactagttccagaggagggcgaggcaggttggcgattcccgtccacagaacatggccaagctattagacggcctagcgccaggtaatatgagcctctagctcagcagtgattcggtaacttcccattactcgtgtctgcagcaaccatggacgaccattcatatatccttccagttccagaggagggcgaggcaggttggcgattcccgtccacagaacatggccaagctattagacggcctagcgccaggtttaatatgagcatctagctcagcagtgattcggtaacttcccattactcgtgtctgcagcaaccatggacgaccattcatatatccttccaacatattcccatcccaaaaatccgatggcttgacctttctcaccgtggtaagatagtcgtgcatatggacctctgcatggataaaagtcttggtcttcctatcgaagatctgtttacggatctccgattcgagcccgtatttctgaagctcagcaatatgtcggcccgcgaaggaccttaaaaccagaagttggacgtaaatccagccccgcttcattgaataagtaaaaaaacaatatgagtagtggtatttcaccgcacacgtcgaaggactaaaggatcgataggccacactttcatggtttgtattcacactgaaaatcaaaatcaaggggacgtttaccccttgattttgattttcagtgtgaatacaaaccatgaaagtgtggcctatcgatcctttagtccttcgacgtgtgaagctatttaaagtttgagaatggatgaaggcaatatatagcccccgggtccctaatcattcgctttacctcataaaactgagatcaataccgaatgtatcaatactagtgggccatttttggtaagcagaactggcgatgcgggatgaaccgaacgcgaggttaaggtgacagagtagacgctcatcagacaccacaaaaggtgttagtacatccagacagttggacggtggccatggaagtcggaatcacggccaggcatatcgactgtacggtaagggtcttccacaaagtagactgctggtgtgggataaattgtgaatgtgttttactactttggtatgatcgaacttgataatagccatttttacaggtatgaaaagcctgtgccccgctatgtgtcgctcgtcggtgggtaattaaaagaatggttaggaaaacgagttggcacagaatagacgccgcaaggaccgcaatcgaggcgataagggagctttttttgcgcccgccagtattctggcgggcatgcctgtctgagcgtcatttcaaccctcatgcccctagggcgtggtgttggggacccactagtattgatacattcgaatgctcacgttcaattaagcaacaagagcttcttacatatttaaagtttgagaatggacccactagtattgatacattcgaatgctcacgttcaattaagcaacaagagcttcttacatatttaaagtttgagaatgtatgaaggcaatatatagcccccgggtccctaatcattcgctttacctcataaaactgagttcaatactgctatcctgagttcttgtcaagtgtgttctgatcctcggtgcagccactttaaggaccttgtttatgatcccatctgggccaggggctttaaatggtgccgtttcacgaattgcctcctcaacttcttgttccgtgattggtggtgtgttgatctggtcactgtatacggcatgctcgatgacctacattgcctctgtcggacgtgacgttcgtagtactttgagcagggtccccagcttcttgacctgctgttgctgttggcgtctgacgctggtcgtgcctctgacttggccgttgagcctctcggagactccgccgccatcgactgggtttgagggcagcccaaaacatctgacgaacagccccttgccgccgtacttcctgtacatcgccctgaagcagctgatcctttggcctcaagaaggtccagataggttgggcattctcgagtcgcatggtcctgggcgcagtagccgcatttgattgttgccttgcactgggttcctatgtggccatatttgtgacattgatagcattgcttcagacgacactgtctgtcgtatcgttcgcattggaagacctctccttgccagatgagtccttaggagatgatagcatacctagactggaataaggcagaagataaacgtgtagaagcgcgggttgctgaggagataaggaaagaccgtctaacaacgggcttggcataatcagcggggaaagaagaccctgttgagcttgactctagtttgacattgtgaaaagacataggaggtgtagaataggttttgtgattagaatcgactcttttacaatttttcgcgatcgggtttggtcataactctttcatatcagattatttcgaacgatattatcataccggcgtgccaacttgtctatgttcgacacccatccgagaacatcaggatcggtcggagatgcgccgaagctctctcctacgttcactttcattacgcgtaggggtttgacatcaggctcccgtctagcagatccaagacgtcactacagattgtctcgagttcattctcaatcttcttgcggtatccgctggtagtggtaatatgctcctcgttaacccttggctgtttctgttgttcgatcgataagatggtgcgcaagctggaacggatctagcaggaagctgccgatttcggtctggtcgccctcggggtagttcggcctgtgaatcggtgttctcccctgctgcttcgtctggggcagcctgatagaacagcttccgatcttccaggtgttccagcaagtattccatgcctgtcatcacctccccctgcttccttgagaggcgttgacgggcttctgcaatgactttgcgtggcttgctgccgttgacgcgtcgatacaaggtagtcaatgggattccccagagcttcgcagccttacgcaagcctaggccctccttattagccaaaatcgcccgttgaagtgcttaatttgactcaacacggggaaactcaccaggtccagacacaatgaggattgacagattgagagctctttcttgattgtgtgggtggtggtgcatggccgttcttagttggtggagtgatttgtctgcttaattgcgataacgaacgagaccttaactcaaggcaaaagtctgggttagtttatttttaaaccaacagcagctcatgtagccagtagagcgtcagctctctgatggtactatggttgcaaccaccactaatcttagccagggaaaatgcgacgactgtgctcacatgattggccaaagtgcttcgtcgccggtgaaataccactactcctattgtttttttacttattcaatgaagcggggctggatttacgtccaacttctggtaacttcaaaccggtctcccgccttccacgcggatcggagggaagtgagaaggccagtatttcaaagagctcgcgaagctgataatcccgctaaagctgcttcccgggccacttttgattttccgcaaaattcattactatgggaaatctaaaaaatcgacttacaaccaccaaaaccttcgaccgatatatatagcttttataagacccacttttatctgaaagaggctcttgagctgatcattcggtaagcgttggattgttcacccactaatagggaacgtgagctgggtttagaccgtcgtgagacaggttagttttacggattttcaagggacgtcgagagcgcaccagacccagcagaggtgctgggctcttccggccattaaaccctagctccggccaaaccgatttcagggtgatagaccgttaagaagaaaagagaactctgcctggggcccccgccgtcgtctccgcgttcaaaactccttcgacgagtcgagtagtttgggaatgctgctctaaatgggaggtatacgtcttctaaagctaaataccggccagaaactccttcgacgagtcgagtagtttgggaatgctgctctaaatgggaggtatacgtcttctaaagctaaataccggcaagagaccgatagcgcacaagtagagtgatcgaaagatgaaaagcactttgaaaagagggttaaaaagtacgtgaaattgggaagcggggatctcaacacatatctggcagagccaggggccgagccggatcgccagtctggtgttcgtgacgcccgaggcagcgatcacgaaggggttccaggacttcatccggcggctacaggcacggcagctgctggaccgggtggttatggacgaaacttttttgattttacataccctgcagcgcccgcgggacgccctcccatgagcctgggtactcttcagaaatacaccgccccacatttaccctcttgcacgccacggtcagttcccgggccagttttgattttccgcaaaattcatttgtatgggaaaagacggccaatcagaaatgaagttcacagtattctaagcaaccgatgattggctgggaattgtcgctgcatgcttgataagaagacggccaatcagaaatgaagttcacagtattctaagcaaccgatgattggctgggaattgtcgctgcatgcttgatattgaggaacaaagcaagctactgcggtgtaggatttggctctggggcataccctataaccccaaaatgtttcacattgggatattctcagacgacctaacctatacccaggctaccctataaccagcctaccctagactaggtcttagatcttgaatatttccttcagctttaaagataagatattcaatatctatactcaactgatcagcttaagagtctcttttagataaaagtggacgtaaaagagccacctggtgcatcattacagttgccccctttgtaaattaatctattgcagccagcatagaggttggagagctattttaataagctgagattcgggatttaatatgctcagactgtatttcgtcagaaggatgagattatccaaggcaagcctcctcgttacagcccgcagtggccgttgcttgaagaagctctcatgaaggaattccaccaggctaggaagctaggtaggctacttcacaaaaggtgttagtacatccagacagttggacggtggccatggaagtcggaatccgctaaggactgtgtaacaactccccaaccgaatgtactagccctgaaaatggatggcgctcaagcgtctcacccatacctcgccctcagggtagaaacgatggcaggcagagtgcaccgcggagaaccacggatgatcaacctgcccaagtctggtcatgaacgcttccctttcaacaattccacgtcaccccaagccagccaataatttctatctaagatttagtaataaatactgtggagactgagggttttctcggtacctgtttccatagcctttataatgaggtcctatagaaccaggttggagatatattccaagcaagttgggacaagacttacaatacaagataccgagttgtaagctcctcgtcaaaatccatcagcgtatcaagcctgtttatattatacagatttaatttatatatatatattatattctgaaactatagtctatacttctttttatagatctaggtaattataatattatttaatcctattaaatattttcttaactccttagtattctaagagcagatacttatagattttctgtcaagtatggaaacaatgtgctggttgacagcacggggaagcctgaggttgcatttcgcatgccgtttggtggactgcagcttggcatgaggtttccctcagcggacacgaggtccgctaatgcaagcgctacagcggacacgaggtccgctaatgcaagcgctacagtggacacgaggtccgctaatgcaagcgctacagcggacacgggcccgggaagcagctttagcgggttttagagtagtttttagtcggtagatctatgagagaaattagtataattttctgactctcataggtgcaccgacccacatttaccctcgtgcacgccacggtcggttcccgggccacttttgattttccgcaaaataaaattatacttatttagaaataagaaaagttagttatataagattattagttaatttatctctataagtatagtatatatttactatgagatcctcttaaaaagctcacacctctgaggggacgacctgatgaacttgacaacattgtggagttttcccaccggctctttctttctccaatgacgtaggtcatcctcgtatcatcgatgaagaacgcagcgaaatgcgataagtaatgtgaattgcagaattcagtgaatcatcgaatctttgaacgcaccttgcgcccgccagtattctggcgggcatgcctgtctgagcgtcatttcaaccctcatgcccctagggcgtggtgttgggacaaagggcagggacgtaatcaacgcaagctgatgacttgcgcttactagggattcctcgttgaagagcaataattgcaatgctctatccactttacataacctgcacctcacataacctgcaccccacaggctatctcaccgcctgtagctcacgctcagtagaccgcccctccctgtatctagccactgtcctcgacttacagcgcttcccaccctctaaaacaataatttaccgcggctcttaacaagagatccgttgttgaaagtttttatttatttgtaaaaactactcagaagattccaaaataaaacaagaattaagtttcaagagatccgttgttgaaagtttttatttatttgtaaaaactactcagaagattccaaaataaaacaagaattaagtttactaggcgggcgcctgatccggggcacacgaggcgcccggggcaatcccgccgaagcaacagtaggtatgttcacatgggtccgcgttcagttgcgttgccgcgcaaaacccacatccaggtgccggaatattgaccggcttccctttcgccacacggcgcaagacgtatacctcccatttagagcagcattcccaaactactcgactcgtcgaaggagtttcacagaggctaggcatccacccgtacggggctctcaccctctatggcgtcccgttccagggaactcggaaggcacgtcgccagaaacatcctctacaaatcgttgcaaagactctaatgcaggggggacagctacctcgagcgtttagaaaatcggctaaaggatatagagtgcacccaagatgagcaggtccctggccaaggcgaggaggcagatggggaagaggatagcaccattaaccaaggcacctcagaccataggcgtcctcccaaagcccaacgtacccaacccttagagccaatccttatcccgaagttacggatctattttgccgacttaggcgtcctcccaaagcccaacgtacccaacccttagagccaatccttatcccgaagttacggatctattttgccgactgcccttatctacattgttctatcaaccagaggctgttcaccttggagacctgctgcggttatgagtacgacctggcgtgaccggtaccccaacttcaaaccggtctcccgccttccacgcggatcggagggaagtgagaaggccagtatttcaaagagctcgcgataccctcttgcacgccacggtcagttcccgggccagttttgattttccgcaaaattcatttgtatgggaaatcaaaaaatcgactcacggccaccaaaccgcgcgaccgatatacccggccggttgcccggctagtggctgcctgctcccgaggcgtcctcccaaagcccaacgtacccaacccttagagccaatcctttagaggtttttactatatataagaggtaatatcctaagatcaggctatatataatataatctatataattagtttttaattaatccgtggccatcaaggataagtaacctaggtctcttggtctcgggcttcgtcaacgggatgaagatcaggtcaagccatacaagagcgatctcgtcattcgtccagcctgttgcagaagctgtaaaaaagtagcaacaaatgcgctagggatggggatcgacgtgccggatgtacgggtagtgctacacatagggctcccacgacagctccgggactatgtgcaggagagcggacgggcagggcgggacgggcaggcaagccaggcggttctcatcagcccgagagatcgggtcaactgtaacaagctggtccgatccgctgtgggaaatctcttcaactgtaccgtatcttgcagattcccactgcgtggtcacttggacaggctaaaggataatgcgcttgtgctgctgctatccacagtctataagggcacagagtttacaacacgtatccggaagcggccgacaacaacacacgcccgggcacaggctatccatacatattttggtgcagagccagtctgagcgaaaggctatccagaatgcagtatggtctgcccagcgcgagtgaaatcatccggtccaggagatatagatgacatcatagtcgacgtcgtgcctcggtgacccggcgcgctaatttccaatgagttccgtcgatatggagaccttgagccatagctatccgggcggcaaaaccgacagtgagccagcttaattattccttcccgcggattttcaagggacgtcgagagcgcaccagacccagcagaggtgctgggctcttccggccatgaaaccctagctccggacaaaccgatttcagggtgatagaccgttaagagactgctggtgtgggataaattgtgaatgtgttttactactttggtatgatcgaacttgataatagccatttttacagatttgaattacaggacggtcttttatatactttgtcataacttgtgcaggggataagcctctggtacgtgccccctaactttcgttcctgattaatgaaaacatccttggcaaatgctttcgcagtagttagtcttcaataaatccaagaacgagagcgcaccagacccagcagaggtgctgggctcttccggccattaaaccctagctccggacaaaccgatttcagggggatagaccgttaagaagaaaagagaactctgcctggggcccccgccgtcgtctccgcgttcagttgcgttgccgcgcaagcatttctgtcaagtatggaaacaatgtgctggttgacagcacggggaagcctgaggttgcatttcgcatgccgtttggtggccttgtaatccatctcccaaaccccctacgcagccagccaccagggccgcctgtattggggaaatcgaggcgaaggacggcaaatccacgccatgttgggcaagaacggtatcaagcttctcaatccgcttgttgctgtgcagaactatgagtataagatgtctaatattcttgataaaccgctagaaagcgcctttggttatgttactgtcttgccaggtgccttttctgcttaccgattccgtgctattatgggacgacctctagagcagtaaactcggtaatgatccctccgctggttcaccaacggagaccttgttacgacttttacttcctctaaatgaccgagtttggtgggtcgggttgagagctaaggttccgggccgcttcctcttgcgatctcttgcagcctgtggagccgcaacaccaacagggccgtaagctgtcactaagcttgacttcctttcaattattgaagaggtgcgaaggaaggctttcaaagagtcaactatcaaggcagcctttaagaagtcaggaatttatcctcttgactgctctattattataaaggatattctcaatcgtcaacctctcaacacgccgtcgccagctcacgaaccctcctcttctgagataacgtctactctgacaccttaacctcgcgttcggttcatcccgcatcgccagttctgcttaccaaaaatggcccactagtattgatacattcgggcatgctcgccagaatactggcgggcgcaatgtgcgttcaaagattcgatgattcactgaattctgcaattcacattacttatcgccaatttccccctttcacaatacaacgaaaataacgcacctcctccagcgttatggctactcaactccttgtttctcaccgtatcacgattagattttaatagtttaataatataattaaagaatattaattactatagttattctaatactaaaactagtttaagttctctatatagtttaaacactctttctagtagccaacaaaattaatgaaaactctttatcccgggagaaaaaatgagaccacggatccacgcgaatctgttgcttatcgtctccacacttagatcgtatcgataagctgtgtatttaactactggctggggggatgcagacccctccaggcctcgaagagatccagctgggaagtatcaaggtactttttgatgagctgatgaataccctcgcctcgagacgtaaccacatttcaccgacgccgcgcacggcaatccaccttccccctctcagttccccagggcatccttccaccacaccaagaccactaggcccggtgcggcttgggcgccccaagaggagtgctcagcgcacagcttcaaccatggcggtgtccgctgcacgtggcgatcttcatttgtatgggaaatcaaaaaaatcgactcacggccaccaaaccgcgcgaccgatatacatgacttttgtaaaccccctcgccgtcacttcgcctttctatatgtgagcctattcagtgggcttttgctgccacagcgcccgcaccaggatttcttgcgccagtggttccccccgacctgagaagagaaagggccgatatccggctcgcgcctcctagcctcgttgatggatgtgtctccgatttcctcaccccctggaaagtccctgagggagattgtcgccatgttcaggtggattgactcagatgtgacaccgttcgcgtatgacagattgctctctaatcttgcgtcgtttgccgcctaccctagactaggtcttagatcttagataattccttcagctttaaagataagatatctaatatctatacttaactgatcagcttaagagcctctttcagataaaattttctatctaataaactttctaataattctattctatttaattctcttctatttaataatactaattaaaatagatatttacttgtgagagctatccctacttattttactagtaatccccttactaattgagtcccgggctctctaggtcaaccaaatcacttggaaggataacgccttggtcttgatgataactaccgtttacaccggccaagagcttatcgtaaagcttcgcaagagaccgacaactacgaaagcaagggcacgcccgatcaagagggaatttagcggaaagccggtttggtggccgtgagtcgatttttttgatttcccatacaaatgaattttgcggaaaatcaaaagtggcccgggaaccgaccgtatagtataaataactatatataaatagatattaggttaatattaaatctatattatttctaataaaaaccttctatagtagtaaatatatattatacttatagagataaattaactaataatcttatataactaacttcaacagcagtagtttcctcttgaactcgagctatataagaagtggttttttacagcttctgcaacgggctggacgaatgacgagatcgctaagttaccacagggataactggcttgtggcggccaagcgttcatagcgacgtcgctttttgatccttcgatgtcggctcgtcctatctcacaattgtaacgccatcggtgtttgtaacgtcctttttgatgggcttttggtggtcgatcgcagatcgacctcctttgcggtttcacaactgtagcaccatcgctgtttgtgacaacttttgatgggtctttggcggtagatcgagtcgatcttctaaatgggaggtatacgtcttctaaagctaaataccggccagagaccgatagcgcacaagtagagtgatcgaaagatggctcttcctccccttattatcttccaagggaagtgggttcaacagcagtggtttcctcttgaactcgagctatataagaagtggttttttacagcttctgcaacgggctggacgaatgacgaaatatgagaaaaccactagagataaaccactagagattattcaagctgactgtgatatattagcatcatatgccttgacatcctgtaagagcaagtcattggatagcaaatgaattagctgtaattctggatggcaaggaacacatgttggttatggatgtagccagcttccatacaactgacgacgtacttcaagacctatgatctcgtaagattacaacagccctgatcccgcccggttgtacaagccttcttcaacctctcgatacagcagtcaataacaggcaagccaggcggttctcatcagcccgagagatatgaaagagggcagagggttggggcgggcagagcagaaggggggggacataagcatgctggcgtttacgcaaggatccagctgccgacgtcttctgctagacgaggtgatggatgggtcaggggacgtgggttagtcgatcctaagccatagggaagttccgtttcaaaggcgcactttgcgccgtgtggcgaaagggaagcagtttacataacctgcacctcacatgacctacactttacataacctgcacctcacataacctgcaccccacaggctatctcaccgccccagtccttgatttcatctggagaaaacgcaaagttgctcccttcgacgccgcgtttcttgagctcctgatctgccatgcgtgttgcaatccaggtcttaccacgaacgtaatggtccagacgcttcaccatcggctgtatgtttggcacgatctgaatcccgcttgtgctcatcagactgtccgctgtcttgaagcatctgccccagaattccgaaattgcgatgatataatgctgactcggcaaaaagccgagactgtatttgagtgtagtaatagcctagccaactgtctcgtaaataccactatctgtgatatgtttggatattccgcatcggagagcgacgagcccctgccgttaaacccccaactttccaaggttgacctcagatcaggtaggaagacccgctgaataaggtttccaaggatgaggactttttcgggacggcactgcgagtagcagtaataaacgaccgtactgacgttgttagttgccttctagaacatgaggcagatcctaacatcacccagccgcattattatcctaaaaatcgcagtccgctcttcgcagcttgcgctcatagccatcatcttagccaggtcattggggacgggttggtctttcacgcgttcgatgtacaggagggcatctctgaggtatctgccgagttgcgtggcaattcttgttttattttggaatcttctgagtagtttttacaaataaataaaaactttcaacaacggatctcttggttctgtcatcgatgaagaacgcagcgaaatgcgataacttcatcgatgccagaaccaagagatccgttgttgaaagtttttatttatttgtaaaaactactcagaagattccaaaagaaaacaagaattaagtttcctaggcgggcgcctgatccggggcacacgaggcgcccggggcaatcccgccgaagcaacatatcgatcctttagtccttcgacgtgtgaagctagaggtgccagaaaagttaccacagggataactggcttgtggcggccaagcgccgtgagtcgatttttttgatttcccatacaaatgaattttgcggaaaatcaaaagtggcccgggaaccgaccgtggcgtgtggagaaggagatgtgcgggatgtaaagatagactggctaccctgcagccgcttcccgagagacagaccgggcgccagaaaattagtaaggggattactagtaaaataagtagggatagctctcacaagaccatccggcgtagccacgcctcgcaaccttccccaatgccacacgtcatctaattagtgacgcgcatgaatggattaacgagattcccactgtccctatctactatctagcgaaaccacagcgatcccagaggctaggcatccaaccgtacggggctctcaccctctatggcgtcccgttccagggaactcggaaggcacgtcgcccagctaagcgtcttgcctgggcggaacagtataaggatattgactggaactgtgttatctggagcgatgaatgcggtgtcgtaaggggccgaggctggatgtgggttttgcgcggcaacgcaactgaacgcggagacgacggcgggggccccaggcagagttctcttttcttcgtaacggtctatcaccctgaaatcggtttgtccggagctagggtttaatggccggaagaaggatcaaaaagcgacgtcgctatgaacgcttggccgccacaagccagttatccctgtggtaacttttctggcacctctcgcttcacacgtcgaaggactaaaggatcgataggccacactttcatggtttgtattcacactgaaaatcaaaatcaaggctccgccgatggcggcatatctggcgatggaggcatacccgcggatgagggtggtggttgtcctgtgtctggtgggaatggtagtggctcttggtcagatggtgccgcgggcgctgctgcctgcggcgtccttattgctcttcgaagaatgattccccgcatcatttccgatcgcgcgtctgcaaatttcatcatacaacccttgggccggaaggattttcgcaatgccgaagcgctgaacgaaatggatttccaataaatccgccattgatgagtgctgtataaagggggtgtgaatcattgatcctggccacgtagaagacggaaatacttacgaaccgagtccaaagaacctctgtcgggccttccggtctggttaccgtgctctactctaggcctcagcactctttatattctcgttgatattcagcggaatttcccctttgcaaaatttagcaccgaaaatcaaggcattgtcagcgactccgtttcctcggtcaatccgtctcaagtatttcaaagagctcgcgaagctgattattctgaccaccacttcaaaaaaagtcatgtctatcggtcgcgcggtttggtggccgtgagtcgatttttttgatttcccatacaaatgaattttgcggaaaatcaaaactattccggcagcagcagcagcagggtgttaggggtatatggctcagtgcagagcgggtcaggaagggggcaggggaggtagagcatttcaccgggtaggcagaaaccacaaccagctaccctatacccggcgaactcaaaccaaatctgccgccgccacgcagcctcgggcagcgcctcggaatgtccttttgtttgggattctattgtaggatatatggtgctgtactgaggcgggccggtaaacgccaacggtttaatatacacaaaagcaaatatatgtagtttcccttggggagattaagtacgatacttaataattttattctatttaattcttttctatctaataatactaactaaaatagatatttatttaacttaaaaagctattttaatctagattaatttaagttagtatattatctattaatactatatatagtactttagattataataattattaagtattagaagaatattattatagttctctataagtatattaaatattaggtttatttatatatctttatattagttagttactagataaagtaatagttctagtaggtataactactagatttatatataagagagtagctttattattataagtaagtttataatagagtataagtttaaataattaatatttaaaaagagatcttaatagttattactaataattactattatatatataagaatctagttacttataataattaagctctagctatagagaataattatattagagatatttattattactattataagagatagttagtaataagttagtaggagagatagttagtaataataagcttaaaaagatattataattaattataaataataagtattcccctttaggatctatagctaaattatatacttaataagcttttcttagagtttttaaagttattattatctatactttagctagctatataataaaaaataaaaaaaatagaattaaaaattaaatatagattagaacttagttaaaaactaattatatagattatattatatataatctgatcttaaaatattactccttatatatagtaaaaacccctaaatatatatatatatatatatatatatatataaatactttatataaaactctttaaaaagttcttaatatattaataataggatttattaataatataaatatattaaactttagatctaatatagagataattaaaaaagaatttcttaagatataaagaaaatataaagaataattaaaactactagcttaatatttaatctaataaaaaataaactaatttattttataaaaagaaagaaaaaaataaaaaaccatacaaatgaattttgcggaaaatcaaaactggcccgggaactgaccgtggcgtgcaagagggtaaatgtgggccggtgtaccatacaaatgaattttgcggaaaatcaaaactggcccgggaactgaccgtggcgtgcaagagggtaaatgtgggccgggtaaggtctcgttcgttatcgcaattaagcagacaaatcactccaccaactaagaacggccatgcaccaccacccacaaaatccgagagaccgttggaatatggatgaagccggtattatggagggagtcagaggtaacgggctggtactaggatcatcaaggaagcaatataccctcctgaagcagtcaggattgagtgtccttgtgagccatccgatatatttgattcccgcgtttgggatgaatggtttgttttcctgtaaaatattatctctggtgtcttcaaattgctccacatccatagagctagtgcctcctattgtttttttacttattcaatgaagcggggctggatttacgtccaacttctggttttaaggtccttcgcgggccggttaactggagccatattcccaatgcattgatttaactaaagtcggcgcacggctagccgaaaagatgaaattccgtgggcgccagtccagtctagtctcgggagagagacgtacctaacgactacccccacggggttcagcctgcaaattcttcccagatgcgccgaagctctctcctacgttcactttcattacgcgtaggggtttgacacccgaacactcgcatacgaagacgaagatgcgccgaagctctctcctacgttcactttcattacgcgtaggggtttgacacccgaacactcgcatacgaagacgcctccttggtccgtgtttcaagacgggtcgttgatgaccattacgccagcatccttgcagagcgcgaacctcagtccaccatctctcgggctgatgagaaccgcctggcttgcctgcccgtcccgccctgcccgtccgctctcctgcacatagtcccggaatctctcgggctgatgagaaccgcctggcttgcctgcccgtcccgccctgcccgtccgctctcctgcacatagtcccggcgctgtcgtgggagccctatgtgtagcactacccgtacatccggcacgtcgatccccatccctagcgcatttgttgctacacgtacagatggacaagaataggcttcggcttagcgtcttagcaggcgattactctacggtactagaagtgtgctgtagtatagaaaccaacctggcgggggttgagactcacatgataatagttgcgtatgtataatagacgatgccagttggagaatgacggcattggagtcgggggcttatgtatccggtgtatttctgaagagtacccaggctcatgggagggcgtcccgcgggcgctgcagggtatgtaaaatcaaaaaagttgttaagtcttatagtttctatatctctagttattatattatttaatctagctattatatatatatattatttaatcttctatatacttctaattatactatagtttaataatgtacagcgtgcacccatctgcttccagtctaggcaccactggtagctcgctttatcgtatcgtagaggcagacccatcgcatgcatggcttaatctttgagacaagcatatgactactggcagaatcaaccaggtaactatcgttcgccggggttggccaatgcatggcttaatctttgagacaagcatatgactactggcagaatcaaccaggtaactatcgttcgccggggttggcccccagcgcccacgaggggcactggagaattagttactgaatggcactcgtgagagcgcgccgaacacagcaccagcggcattgcggccactggccacaaccgctaataaccccctgctaacgctagccaatagcggctgcagccactgtgggtcagtggttacagcccgctatgaccgctacggcttagcgggccctaggaaccctcaggggtccgggccaccagcagagctattattagggatgtaaagatagactggctaccctgcagccgcttcccgagagacagaccgggcgccagaactctggcgtccttgtaatcctaacaaccaacttagaactggtacggacaaggggaatctgactgtctaattaaaacatagcattgcgatggccagaaagcggccagccaggcccaaggttcaactacgagctttttaaccacaacaactttaatatacgctattggagctggaattaccgctgctgctggcaccagacttgccctccaattgttcctcgttaagggatttaaattgtactcattccaattacaagatccaatattcaatgaagcggggctggatttacgtccaacttctggttttaaggtccttcgcgggccgacccgggttgaagacatggtcaggtggggagtttggctggggcggcacatctgttaaaccataacgcaggtgtcctaaggggggctcatggagaacaatgcattgatttaactaaagtcggcgcacggctagccgaaaagatgaaattccgtggcgccagtccagtctagtctcgggagagagacgtacctaacgactacccccacggggttcagcctgcaaattcttcccgaatcagcggggaaagaagaccctgttgagcttgactctagtttgacattgtgaaaagacataggaggtgtagaataggggggagcttcggcgccggtgaaataccactactcctattgtttttttacttattcaatgaagcggggctggatttacgtcggtctcgttcgttatcgcaattaagcagacaaatcactccaccaactaagaacggccatgcaccaccacccacaaaatccagaaagagctctcaatctgtcaatcctcattgtgtctggacctggtgagtttccccgtgttgagtcaaattaagccgcatcaacattgctctatcaaattgggactgatattactgttgatgagtgtattcagggctttacaggtagatctaggcagataacaactgtccctaataagccgactccaacaggcttcaagatatgggttctaggccaaagaggctatttcctccgctggtcacaaggcaagtgttcctttgcttcttaggctcgttccgaaaggcattggcggaccccgtaggggaccggtctcctgtacctcataaatcaatttgcctgaggaacgcaagagacgaaggatcttccttccgcgccctcctaacccaagcttagaccaccgagcggtccgtgcaacacctccctcaactcctccaagggccgggatgaagcgtaaatatcattacgaaccggatatttcaacgcccaagggcagccaccagttccggaagatcattcgcgattttatcgatgataaggtcatcgatccaccgatgagactgctattccggaagatttgcaagggtcttgacgaacaacaagtgaagatatcacgaaggagatgtgcgggatgtaaagatagactggctaccctgcagccgcttcccgagagacagaccgggcgccagaactctgaaggagatgtgcgggatgtaaagatagactggctaccctgcagccgcttcccgagagacagaccgggcgccagaactcgggcgtccttgtaatccatctcccaaaccccctacgcagccagccaccagggccgcctgtaacatggtgtcttggtgcgccccagctcttcaacagtgcgatagtgctgggcttgctggccatccaagagcagccaccatctgcgattgatttgaacccggttatcaacgatcttcagtctttctgtgacaaggaaagaaatgaaaaatgggtgaacgactgtactaacaccttttgtggtgtctgatgagcgtctactctggcaccttaacctcgcgttcggttcatcccgcatcgcccgttctgcttaccatttgtggtggtgcatgcacgctgtggtggaatttacagtggcgtgcattcgctgtggttggatttgtggtggtgtgggtgcctagctccggacaaaccgatttcagggtgatagaccgttaagaagaaaagagaactctgcctggggcccccgccgtcgtctccgccctcacataacctgcaccccacaggctatctcaccgcctgtagctcacgctcagtagaccggccctccctgtatctagccactgtcccatacaaatgaattttgcggaaaatcaaaactggcccgggaactgaccgtggcgtgcaagagggtaaatgtgggccggtcccggcgatgtgcatgtgctgtggttggatttgtggtggtgcatgcacgctgtggtggaatttacagtggcgtgcattcgtaaggtgccagagtagacgctcatcagacaccacaaaaggtgttagtacatccagacagttggacggtggccatggaagtcggaataaggtgccagagtagacgctcatcagacaccacaaaaggtgttagtacatccagacagttggacggtggccatggaaggcggaatccgctaaggactgtgtaacaactcaccaaccgaatgtactagccctgaaaatggatggcgctcaagcgtctcaatctagtggcggacccgtcgtggcctcctctgcgaagtagtgatattccgcatcggagagcgacgagcccctgccgttacacccccaactttccaaggttgacctcagatcaggtaggaatacccgctgaacttaagcatatcaataagcggaggaaaatcaaaaagcgacgtcgctatgaacgcttggccgccacaagccagttatccctgtggtaacttttctggcacctctagctgcacacgctgcaaggatgctggcgtaatggtcatcaacgacccgtcttgaaacacggaccaaggagtcgtcttcgtatgcgagtgttcgggctttccctctgtggaaccctatgcccttcactgggtgtagcggggaaacaggacttttactttgaaaaaattagagtgcgccaggcaggcctttgctcgaatacattagcatggaataataaaataggacgtgtggttctattttgttggtttctaggaattggtttttaatctaataaatacatcccttccgaagtcgggattttaagcatgtattagctctagaattaccacggttatggggttggggggtatttctcctttccgttatatcggggttgggggcctctctcttttctgttatatcggggttggggggttgggggcctctctcttttctgttatatcggggcctgtctgagcgtcatttcaaccctcatgcccctagggcgtggtgttggggatcggccaaagcccgcgagggacggcctgcccctaaatctactaagggcatcacagacctgttattgcctcaaacttccatcggcttgagccgatagtccctctaagaagccagcgtacttccaaagcaatacgggctagttagcaggttttggctctaagggttgggtacgttgggctttgggaggacgcctcgggagcaggcagccactagccgggcaaccggccggggccgcaggctccacccctggtggtgcccttccgtcaatttctttaagtttcagccttgcgaccatactccccctggagcccattcgtcagaaggatgagattatccaaggcaagcctcctcgttacagcccgcagtggccgttgcttgaagaagctctcataaaggaattccaccaggctaggaagctaggtaggctacttactgttagctggttcaagaggaaagcgtacaagcttttctgaccccgctcgttttaaaattacaatacgcgaaatactacagcacacttctagtaccgtagagtaatcgcctgctaagaccctgatccggaggtaatcgccaagagattttcattagtggagaggttagtagagctcagcaattactatccacatcccaaagtaacaatctccctgatccggaggtaatcgccaagagattttcattagtggagaggttagtagagctcagcaattactatccacatcccagagtaacaatctcctataagcgctagagagctaggtagatctatattaaggctggaaaaacttaaagcttattagagatacagaatcagcggggaaagaagaccctgttgagcttgactctagtttgacattgtgaaaagacataggaggtgtagaatacgtgggggtttaatggccggaagagcccagcacctctgctgggtctggtgcgctctcgacgtcccttgaaaatccgcgggaaggcataattctcacgccaggtctcctcgccaatcatgcagaatgcagctgcttaccgcctctgggagcggtgtgcttggatctctgatcttgtacactaatcattgggataatgatgggttgagaacgatgtacaaaatccacggcgaccacggcatctgactacaaactctgatacctatgcagctaacgataagacttggtttgacttccgatgtggctctttgatgttaacaggaagcattcctccaaggtcagtgcaggcttcccaaacaggttgctgcgtgctgaagccaggagctgcgaaggctcgtacggctatatgccttccttctctcatccacttagtgactccgttggtagtcactttcgcattttttcaacgtggatttcagtgaatataatatcggcggctttggcgctcttggtcccggctgtcctctacgtcgccatcccgtggcttctttagccgcgcaatcagcatcatattttcacttctttttgattcatattgtgggtctctccactcacacatcctaatcggggtacatatctaataatcttcaaatatctacaaggattatcggttctacaccaggacttgacatggtggcttgactgcatagcagattggtagttcgggattttgttttggtaggaatcagattccaacttagaaatacttgttattataatccgctgaaactgacgggatctgaaggaatttgaccggctttccgctaaattccctcttgatcgggcgtgcccttgcaatcattcttttattcctggtcaccaggtatgtatacatattggcattgaacaacagaccttttctttgggtgggtacactaattaattaaataattagtactttaagttagaaagaaaagatagttattactattagataataagctttccctcttagaggctatagctatagctagattatttatatatctagctgtataaatagctcctattattagagtttttaaagtattaatacctatacccaggctgaaagcgactcacggccaccaaaccgcgcgaccgatatacatgacttttgtaaacccgccatcccatctcttctaagctaccctcaaggctatatcgcctaagatactggagaaggagatgtgcgggatgtaaagatagactggctaccctgcagccgcttccctgggcaggcagagtgcaccgcggagaaccacggatgatcaacctgcccaagtctggtcatgaacgcttccctttcaacaattccaagaacaagggtagcaccatttcctggactcctgggtaatttctgaactcttaagttcgcattactaatgcttgtattatttttgttcaagttaaatacaggccagaacgcagccttcaattactcttcaaatggcaactcgcacggtttacacaatatgtgcacaaggtccatcatctaacattgctttcctccgccacatctctctgggcatggcccgcattggcaactggcgtaaggcattcccctcgccttcaaaccaagccggcgaagtgtcggggggcatgagcgtaggttcactaactaagtgctaaggttctcgtacagcggatacgaggtccgctaatgcaagcgctacagcggacacgaggaccgctaatcaatatcatcttggaactcttctaggtcgtcttcaggaaaagcatagtgcagtacgtctgttaatctcgctgacttgggtggcgcagccttcttttgctttgcagattgaatgtagttgactttgaagatgggttctgtggatggatggccgctggctaaacttaccactgagcaacgggagatcgccacgtgcagcggacaccgccctggttgaagctgtgcgctgagcactcctcttactagggcaatccctgttggtttcttttcctccgcttattgatatgcttaagttcagcgggtattcctacctgatctgcggtcaaccttggaaagttgggggtttaacggcaggggctcgtcgctctccgatgcggaatatcactacttcgcagaggatttgcagacgacttagctgtgcgaaacggtcctgtaagcagtagagtagccttgttgttacgatctgctgagggtaagccgctcgcgcccctctctcataggtgcaccgacccacatttaccctcgtgcacgccacggtcggttcccgggccacttttgagtttccgccagtgtagcgcgcgtgcggcccagaacatctaagggcatcacagacctgttattgcctcaaacttccatcggcttgagccgatagtccctctaacgggacgccatagagggtgagagccccgtacggttggatgcctagcctctgtgaaactccttcgacgagtcgagtagtttgggagcgaacgtcttgagcgaacgtcttgagcgaacgtcttgagcgaacgtcttgagcgaacgtcttgagcgaacgtcttgagcgaacgtcttgacagcgcacagcttcaaccatggcggtgtccgctgcacgtggcgatctcccgttgctcagtggtaagtttagccagcggcccagcgcacagcttcaaccatggcggtgtccgctgcacgtggcgatctcccgttgctcagtggtaagtttagccagcggcgatccatccgggtttagaccgtcgtgagacaggttagttttaccctactgatgacctcgccgcaatggtaattgagcttagtacgagaggtcccgggccagttttgattttccgcaaaattcatttgtatgggaaatcaaaaaaatcgactcacggccaccaaaccgcgcatggagaacagaaatctccagtagaacaaaagggtaaaagtccccttgattttgattttcagtgtgaatacaaaccatgaaagtgtggcgtcgtgggtatggttgcgagttcggttgcgaatgtggtcgcgagtgtggtcgtgggtgtggttgtgagtgtggttgcgagtgtggtcgtgggtaggttgcgagtgtggttgcgagtgtggtcgtaagtgtggttgtgagtgtggttgcgagttcggttgcgaatgtggtcgcgcgatgctgatactggtatctttcgatccgcagttacaactgtttgggttggaaggctcgatagcaccattgcctaagtcgatccctgcatcattggagggtgaattcaggactaggccttggtccgacagagtgcggccattctaccttaggcttcgtctggggaaagttcttagccagactaaaaaatagtgtactcaaacaaaacttactcctggcatccaagattccaacggccatagtccttgcctatctaaacgcctggaacatcgtcgtctattcagccagcctaccctagactaagtcttagatcttagataattccttcagctttaaagataaggtatctaatatctatactcaagccagcctaccctagactaagtcttagatcttagataattccttcagctttaaagataaggtatctaatatctatacttaactgatcagcttaagagcctctttcagataaacggattgtaattggagaagatgggcgaactccctgaatggcgatcgtagaccataatgcaacgtaggccactcaacatcgcacatctctagtttggcggctcgggagtgaagggcatagggttccacagagggaaaggcccggccggaccagtacacgcggtgaggcggaccggccagccaggccagtgaagggcatagggttccacagagggaaaggcccggccggaccagtacacgcggtgaggcggaccggccagccaggcgcaaggttcaactacgagctttttaaccacaacaactttaatatacgctattggagctggaattaccgcggctgctggcaaagactgccacgtaattggtcaggttagatgctcgttgttctcgcactcttctgaaaacggcgcattgccaaatgacgcattgccaaatgacgctttgccaaatgacgctttgccaaatgacgaagactgccacgtaattggtcaggttagatgctcgttgttctcgcactcttctgaaaacggcgcattgccaaatgacgctttgccaaatgacaatttgcgagacgacgtattggctttcccaccatgcacctttcggcgtatactctaaatgaccgagtttggagagctttccggccctgagtggtggtttccctcctctctgggccagtccggacgcctcacggagccattcaatcggtagtagcgacgggcggtgtgtacaaagggcagggacgtaatcaacgcaagctgatgacttgcgctggcttcgctttgacattcagagcactgggcagaaatcacattgcgtcaacaccactttctggccatcgcaatgctatggtttaattagacagtcagattccccttgtccgtaccagttctaagttggttgttaaccgtacgccggacggccgaagcctttttcttttcttttcttttcttttcttttcttttcttttcttttcttttcttttcttttcttttcttttcttttcttttctttttatttccttatatagaataaagtatctatactttataagtctattaataactattagaatactattatattctactctaattataagttctttagattttaatagtttaataatataattaaaagatactaattattatagttattctaatactaagactagtttaagttctctatatagtttatattatatagatttaatttatatatatatattcggcgcttgcttagtacctcatttgccgtacgaagatcccggacctcagcacgtaaaagagccacctggtgcatcattacagttgccccctttgtaaattaatctattgcagccagcatagaggttggaggggagggagtattagggttacttagggttagagttagagagtatttagagttagtatatagttagaggtagtatatagattaagggagtaagtatttataataagatatattaataaaataagtataaaatagagaaaaaaagaagaagctaaatagacagctcggtgccgaccatgagcctctcgagcacgtccttgtggaaccgcgtaacctcccagtcgaacttgcccggccgctaccagccgaagccgtgcagcttcatgctcctgccgatgccgagcccctcagcctcgaccgggggcctgccctcgatctgcatgccgtttccattcactctgctatgtgaccttctcaaccgacttgaaagaaactacaagccatcgagcatcgacaagacccaggaagtccacgcccgggccgttgtctcctggtttcacaaacacaatgaggccattccacgacgaggcacagaagccattgctttcctgtcctgtctatatgaagaatattattcctattaaattctatttagatgttacaattaaataaaagattattttagtacttattttatattagtattaaaaaaaaataaaaataaggaaattagatttcctagtgatatatataaagctcgagaagctcagaggttgagtcccctggaccttgcacttccatggccctgcctttatcaagtacgcggtcgacattgcacacgccgcttcggtccctgtctctgttcatctcgaccactgcttgaagccgagcgatgcggatctggcactagagtgtgcattcgactccatcatggtggatgggtctaatgcaagctaagcgtgccacctaccacgacgagaaaatctgccagctaaaccctttacttggccacagcatctttgacggtagtgctgtacattgcccaacaatgataatgatctgccaagctttccgatactggacgatattggattcctagctccttgcccacaaaatcaagaaagagctctcaatctgtcaatcctcattgtgtctggacctggtgagtttccccgtgttgagtcacattaagccgcaggctccacccctggtggtgcccttaaacgtatttttccattcaactactaagactctaagcatcttactgactcccaagactgcatcgtgaaatttgtggtaaactccatggtcaacgtggggattgttaacgccttaacagcaggagaggatacctaatcggttaccatcctctgcaaaaacgtatttttccattcaactactaagactctaagcatcttactgactcccaagactgcatcgtgaaatttgtggtaacgtaatccacaagtgagcgggccacacaagcgagcgggccacttccttatcgtaccttaaatagcgttttttctaacctgcaccccacaggctatctcaccgcctgtagctcacgctcagtagaccggccctccctgtatctagccactgtcctctactgccgacatcgaaggatcaaaaagcgacgtcgctatgaacgcttggccgccacaagccagttatccctgtggtaacttttcttttgagaatggatgaaggcaatatatagcccccgggtccctaatcattcgctttacctcataaaactgagttcaatacttctatcctgaggttgaatgcagggttgatgtttggttctttgtcgctgcttgggcgtagctcgaaataggcgatgtctagagctggttcccgagggaggcggcccagaacatctaagggcatcacagacctgttattgcctcaaacttccatcggcttgagccgatagtccctctaagacagctaagtcgtctgcaaaggatttgaccccgctcgttttaaaattacaatacgcgaaatactacagcacacttctagtaccggtggttttattatccatcaactcccaagtgtggtggatcggtctcgagtttgttgggcggaaagtaagttaacagtccagcctaaagagcgcagttactaggtgactggcgatcttcttgttttatctgctcatccacatcattctggtcccgaagagcttgtccctcatcaatagtcatgctgtcaccttggcgtagacgcgttctcttagctctacggcgcttgcttagtattgcatttgcctctcgaagtagctggttctcgtttagctgcatgttgaagtgttcttccaaatcagtagctcggaccttggccagccacgtaagtttcaacaagtcgtccattctgccacagcaacgaacatgaccaggttttgtcgggtgcggagtatataaatcctgattatgataaacgtctagagtatatttattttaattagtattattagatagaagagaattaaatagaatagaattattagaaagtttattagatagaaaagttaaatatttattttaattagtattattagatagaagagaattaaatagaatagaattattagaaagtttattagatagaaaaattaaattagtaatagttagattaattcttatactaaactattatatataatctatactattagtaatagttatatctaattattctatttatagttaatatatacttatagatactagtttcaggggttctcttttttgccttgccccttcgctctattgaatctaagcaagaaaccaactatatacaaaatcgcctttactctgatatctggcacttggtcaaccccagtcatgtctcctccccaaatcactgctcgcgagctacctagattggagtaaggcggaagatgatcgggttgaggctcaggtagccgcagagatggaaagcaatcctttttctgttggtagaagaggcatgcgagagatatggagcattgctttggcactcggctcagttacctcgcggcctgtggatggatcctttatggctggcgtggttgtaggtgctggggcctccttgttcctcgcccacttggcgagtttccaaagcggtattgtaattttaaaacgagcggggtcaaatcctttgcagacgacttagctgtgcgaaacggtcctgtaagcagtagagaggacgtgtggttctattttgttggtttctaggaccgccgtaatgattaatagggacagtcgggggcatcagtattcaagtgtcagaggtgaaattcttggatttattgaagactaactactgcgaaagcatttgccaaggcttttctggcacctctagcttcacacgtcgaaggactaaaggatcgataggccacactttcatggtttgtattcacacttaaaatcaaaatcaagcaactgaacgcggagacgacggcgggggccccaggcagagttctcttttcttcttaacggtctatcaccctgaaatcgggttgtccggagctagggtttaatggccggaagagcccagcacctctgctgggtctggtgcgctctcgacgtcccttgaaactctttgaagcagtgtacagttttcaaagagcttcgtcggtttgagcccgcagaagctccgaatgacctgccagacgcagaaggtcgaaagaaggccgcatgcccagccattcttttggtcggggacagggcagcaaactccgaggaagttgtacggctagagcgtcaatacccatgtctgaacctgaagaggagacattgcttggcgtataatcacaaccgacttcatgcagctctcagtgtacactgcctcttgaggcagagaactgtgactctcctcacctgtctttcgtcatcgtgtttgtcacctggttggtgggatagcccagccagctgcatttaccccttggatcacagttgcccactcccggttaccaggctggactagcttagccttcgtacgaccctctgaggtagtaaccaccattccagggaagataaccgtagctcccttagcagagctcttacgatgtaggctgtatgagaaggggcattatcatgcataaagatatcccctggaccacgacaaacttccaacgagaaaacctctccgtgtcgcttttgcaatcgtcatgcgctacatgtgtcgccgcaaaaatcactaagccagcgttgaacgcttggcgccactcgtgcaaggtccggaacggcttccaatttggctggccatgcttctgaagtaaaaagctattgcaaagagcgatctcgaggagaaagccccacgctaatgcccgccaaggtcccttacaaacccggtgttccaatccctcttgggcccgaagctggtcaccctgatctacagcacccatggccaccttcaactcctccctcaactcctccaaaggccgggataaagcgtaaagatcatcacaaaccggatatttcaacacccaagggcagtcaccaggtccggaagatcattcgcgattttatcgatgacaaggtcatcgatccaccgatgagactgcgcgttgccgcgcaaaacccacatccaggtgccggaatattgaccggcttccctttcgccacacggcgcaaagtgcgcctttatgtagtagccgtttctcaggctccttctccggggtcgagccctaaccctccgttacccgttgcaaccatgtttggccactacccaaacatcgaaagttgatagggaagaaatttgaatgaaccatcgccggcgcaaggccatgcgattcgagaagttaaattgttcctcgttaagggatttaaattgtactcattccaattacaagatccaaaagaaccctgtatcagtatttattgttcagtgtatcaggatggtctgctccaagcttcgtctgaagaatctccatcacctgcacctcaagcttctctgcctcctccacaacccacaacagtatacataagcaactggaagtcagccatagcgtgtatcaccccgctaaaattccaaccccagcgcaccccaaaggctcgattgatcggtctaacagatacgaatattcgctcgggctggaaggggtccggcttgtggcctgttaatatagctaaacccttgatgagcccgtatgtgatgaagccggtgtttgggcccttccggccaccttcaactcctccctcaaccggcattgattggacactattgagtcaaaatctatttttgctgcttatctgctgacctatttactactttgttcgctatcatagttacagctgtggagcgtatgggaatctcacggaggcagtgcccaaaagtccttcagacattgtcgctacatcttctgccatgacaaagatgcacgctgtggtggaatttacagtggcgtgcattcgctgtggttggatttgtggtggtgtgggtgcgctgtggttgatgatgtagtgggttgggtgcgctggggttggaattttagcggggtgatacacgctatggctgacttccagttgcttatgtagcagtagtgatctgggctgccgaggtcgggtggctcgtccagtcaatgctgtttacacaggccttcgtcagcttggttgtagtacgctggcttcttagagggactatcggctcaagccgatggaagtttgaggcaataacaggtctgtgatgcccttagctgttctgggccgcacgcgcgctacactgacggagccagcgagtactcccttggccgaaaggcctgggtaatcttgttaagggatgcctcagagacaggtgaggtgcttgggcagtccgacttacccagcactttcggcgacaggtactctcaacctgctgtcgggaaagactaatcgaaccttctagtagctggtttccgccgaagtttccctcaggatagcagtattgaactcagttttatggggtaaagcgaatgattagggacccgtggtggaaggatgccctggggaactgagagggggaaggtggattgccgtgcgcggcgtcggtggccctgccgctggtgcggtgttcggcgcgctctcacgagtgccattcagtaactaattctccagtgcccctcgtgggcgctggtggccaaccccgggtcaatcgcgaggctcaacgcgttgataataacagcctgccgcggtcagggcagccgaggaagctatctgaagagaaccagcagcttattcgcaatgagatagatcgcgatccacatatacagaaccgcgagctactattcaaggtcaataacgtctgttttggcaggaaggctttcgtcagcatggtacttttaggatcaagtggaagatgcggacaatcatcgaggaacataatgagattttcttttctgtcttcttcggaaacccgccatcccagttcccacccgagatgccgcctccaaagcccagcaagatagtcatctttcagggcttgacgcgcttctttcctgtaactggccgggtgcttgcatgatcatggtgagagtgtctgggtgtgctatgtagtacctttccattttctggtctaaagggcctgcatcgtattttccgccgtgattttcgattcggctcgggccatttgaagcgcgtcgtgtatggtaccgaggtcgggaatgttgtggattttgttaacgaaagatagtgcgctcatagccatcatcttagagaagattccaaaataaaacaagaattaagtttcctaggcgggcgcctgatccggggcacacgaggcgcccggggcaatcccgcgattcccactgagtggtcacttggacaggctagacggcttcggcttcgctggcgggtgattcatagtgggcgtcgacccccacgaaagcggtctcccaaaccccctacgcagccagccaccagggccgcctgtattggggaaatcgaggcgaaggacggcttaccctcagcagccgtacaacttcctcggagtttgctgccctgtccccgaccaaaagaatggctgggcatgcggccttctttcgaccttttgcgagacctgctgcggttatgagtacgacctggcgtgagaattattccttcccgcggattttcaagggacgtcgagagcgcacaatcccgacttcggaagggatgtatttattagattaaaaaccaatgcccttcggggctctctggtgattcatgataactgctcgaatcgcatggccttgcgccggcgatggttcattcaaatttcttccctatcaactttcgatgtttgggtattggccagatattgaatatcttatctttaaagctgaaggaactattcaagatctaagacctagtctagggtaggctggttatagggtagactgtttatactattagtaatagttatatctaattattctatttatagttaatatatacttataagtattattctagagtttagtttaaatattctatttaactattactttatagatagtaagctattaaaagcttatattttatacctatttatactataacccttagagccaatccttatcccgaagttacggatctattttgccgacttcccttatctacattgttctatcaaccagaggctgacccccacaagcacacgtccggatgcgtggaggtatggtgagggttgacatttccagacatgcttaactcggcatcttgctcgatgccgtggcaactggtccgaacatgtccggagctagggtttaatggccggaagagcccagcacctctgctgggtctggtgcgctctcgacgtcccttgaaaatccactggagatttctgttctccatgagccccccttaggacacctgcgttatggtttaacagatgtgccgccccagccaaactcccactggagatttctgttctccatgagccccccttaggacacctgcgttatggtttaacagatgtgccgccccagccaaaccccccacctgacaatgtcttcaacccgggtcggcccgcgaaggaccttaaaaccagaagttggacgtaaatccagccccgtggggccgaggatagcaagtcgtgtctctgttgtaatgaagcaacggttgataagatggtaatagaaataggtaaaaaatttttttaccacgatttcattttcaattcaacgtagtataaccctacgaaaactcctcaatgacgctacgcggcttgagccgatagtccctctaagaagccagcgtactgccaaagcaatacgggctagttagcaggttaaggtctcgttcggtatcgcaattaagcagacaaatcactccaccaactaagaacggccatgcaccaccacccacaaaatcaagaaagagctcgcacgaatagggccagatggagaacagagttactggacggaaatgtgagaacaagcctcggggttagcagtgtaagctcggggcataccgtctgaagtacactgggtgctcgtcatggtgatcgtcgctgataaatccttgaaaaatcggcacggcgtactggccagagctaccatgttggtagttcaccatcaacccgaagccagcgagaaggtaagaggatcagggaacaccaaagttggtactctgaaaatactatactgacaataacggtggtatattcagtggctaagggtcaacatcaggcttatcgaaacggggttcaggaatctaggtgaaagtggttgcttcgggacaggtgagaacggcgtatgcctccacgtctagagtccgctgataaggttccaaaacccgctagacgttgcagtggtttggtaagacatactatgtatctggcctgaaccgaatgatgatgagatgctaatgaattatatagtattactgcgagagtgctctgaatgtcaaagcgaagccattcgaccaagcgcgggtaaacggcgggagtaactatgactctcttaaggtagccattgaaagtttttatttatttgtaaaaactactcagaagattccaaaataaaacaagaattaagtttcctaggcgggcgccgctaggatatcatatctgatttgaattgattgaattgattgataaatctgattgataatctgatctgacggcagccctgtgcccaaggcatttaccgcgatgatgtaaactccttctgcgactggtagtggcagaggcgatatcacaaaggaggagccattaatagtaacttatattatatagcttataataatctgattatactacttagaataatactctaattagtttaatcctaatttactctagacctctatctagtataaattatctaactattatatattaataactcttatttagctaattaccttatcttaattactatataaaagcatatcaataagcggaggaaaagaaaccaacagggattgccctagtaacggcgagtgaagcggcaacagctcaaatgtgaaatctggcgcaagcccgagttgtaatttgtagaggatgtttctggcgacgtgccttccgagttccctggaacgggattgccccgggcgcctcgtgtgccccggatcaggcgcccgcctaggaaacttaattcttgttttattttggaatcttctgcgtagtcccgccttccgcgcggatcggagggaagtgagaaggccagtatttcaaagagctcgcgaagctgattattctgaccaccacttcaaaaaaattctgtagcggaatacatatatcaggggacagtgactgattcagacgtttaatcatagattgtacttccttaaggccccgctccttatccatttcaggttcaacaattaagaaaggggaaggtttgccattaccgccgaccattgctgcccttatgttacgtggaggtcagtgacgaagcctagggcgtgagcccgggttgaacggcctctagtgcagatctcggtggtagtagcaactacttcaatgagaacttgaaggaccgaagtggggaaaggttccatgtgaacagcggttggacgttccagaggggtgcctggcggtgttggtgttaataatcgtacatccagctttgaaagaaccctttttgcatctaaaggaataagtccagctcctctaaaacccccctggatattttccaccgcatttaaagctgcaatgacggaacaaactatccagggcgcttttagaggtgcaggccttattccatttgacccaaaaagcgtcttgtcagacagaccgggcgccagaactctggcgtccttgtaatccatctcccaaaccccctacgcagccagccaccagggccgcctggacagaccgggcgccagaactctggcgtccttgtaatccatctcccaaaccccctacgcagccagccaccagggccgccaggagacagaccgggcgccagaactctggcgtccttgtaatccatctcccaaaccccctacgcagccagccaccagggccggctgcttggtgtggtggaaggatgccctggggaactgagagggggaaggtggattgccgtgcgcggcgtcggtggccctgccggtgaacgagtcaatttttaacatcgtccgatccctagtcggcatagtttatggttaagactacgacggtatctgatcgtcttcgaacgagtcaatttttaacatcgtccgatccctagtcggcatagtttatggttaagactacgacggtatctgatcgtctgcccgacagtgatagaccactggcatggacgatcgaaccccgtgctaatgcgcttgtgtggatatctcggaagaagccaatcatgccggttttagctcgtgtcactttgtctcgtaaaacaataggagtagtggtatttcaccggcgccgaagctcccacctattctacacctcctatgtcttttcacaatgtcacactagagtcaagctcaacagggtcttctttccccgctgattctgccaagcccgttcccttggctgtggtttcgctagattttccgcaaaattcatttgtatgggaaatcaaaaaaatcgactcacggccaccaaaccgcgcgaccgatatacatgactgttgtaaacccgccatcccatctcttctaagctaccctgaaggctatatcgcctaagatactggagaaggagatgtgcggtgggtacgttgggctttgggaggacgcctcgggagcaggcagccactagccgggcaaccggccggcggcagccagcaccggggtgctgatgcccttagcaggcttcggccgtccggcgtacggttaaccctgcacctcacatgacctacactttacataacctgcacctcacataacctgcaccccacaggctatctcaccgcctgtacctgcacctcacatgacctacactttacataacctgcacctcacataacctgcaccccacaggctatctcaccgcctgtcgctcacgctcagtagacgggacagtcgggggcatcagtattcaattgtcagaggtgaaattcttggatttattgaagactaactactgcgaaagcagttgccaaggatgttttcattaatcaggaacgaaagttaggggatcgaagacgatcagataccgtcgtagtcttaaccatcaagctgacattcttgttatagcaggatgggaaatggatgtcagcgcgatgtggttatgctaaatcatcacagtatcggttagggaacccaataccctgttctttattgaagtgatcaccgatgtatactgacaaccattggatcccactagctaaaactgcaagaaccggtctttgggcatgaatttagctattggatggaccggaagctgctgaccggcttggggagccttccagtggtcagaatatcgtgtctccctatgaatccccatataaactagatagcccagccacagatagatctctgctgttgtcgttctgctcaataccaatgctcccttttctttctttagcgatgcattctttcaacaactcgcctggcgacttgaccctcacccatctgaccagatatcatggagccggcaatcaatgagccgtctgcttgatgacacgtataggtgcaagaaggatgaggtcttttgattttccgcaaaattcatttgtatgggaaatcaaaaaaatcgactcacggccaccaaaccgcgcgaccgatatacaccgtggcagaaaggacgacttgttgaaacttacgtggctggccaaggtccgagctactgatttggaagaacacttcaatatgcagctaaacataagggcagcaatagtcggcggtaatggcaaaccttcccctttcttaattgttgaacctgaaatggataaggagctgggccttaaggaagtaccaagaattaagtttcctaggcgggcgcctgatccggggcacacgaggcgcccggggcaatcccgccgaagcaacagtagggctgggtttagaccgtcgtgagacaggttagttttaccctactgatgacctcgccgcaatggtaattgagcttagtacgcgaggaaccgctcattcagataattggtttttgcggctgtccgaccgggcagtgccgcgaagctaccatctgctggataatgacgaagcctagggcgtgagcccgggttgaacggcctctagtgcagatcttggtggtagtagcaaatacttcaatgagcacttgaaggaccgaagtggggaaaggttccatgtgaacagcggttggacgtgggttagtcgatcctaagccatagggaagctgctggcaccagacttgccctccaattgttcctcgttaagggatttaaattgtactcattccaattacaagatccaaaagtctagcctgtccaagtgaccactcagtgggaatctgcaagatacggtacagttgaagagatttcccacagcggatcggacgcctacccggtaccccaacttcaaaccggtctcccgccttccacgcggatcggagggaagtgagaaggccagtatttcaaagcggggaaactcaccaggtccagacacaatgaggattgacagattgagagctctttcttgattttgtgggtggtggtgcagggccgttcttagttggtggagtgatttgtctgcttaattgcgataacgaacgagaccttaacctgctaactagcccgtaacctcccatttagagcagcattcccaaactactcgactcgtcgaaggagtttcacagaggctaggcatccaaccgtacgcggctctcaccctctatggcgtcccgttccagggaactcggaaggcacgtcgccagaaacatcctctacaaattacaactgcgggatgtaaagatagactggctaccctgcagccgcttcccgagagacagaccgggcgccagaactctggcgtccttgtagagggttggtgtgtactttaggacactgtccagagcgcttgatgaatgcatcgatgagtgcgaatcggcccgggaatctatgccctaggaaccctcaggggtccgggccaccagcagagctattattaggttatcgggcttatctagcccagataagggggtactcataaccgcagcaggtctccaaggtgaacagcctctggttgatagaacaatgtagataagggaagtcggcaaaagagatccgtaacttcgggataaggattggctctaagggttgggtacgttgggctttgggaggacgcctcgggagcaggcagagtctgccacagcagacgaaagtggcgacgcgttaccacattacagatatggtggcgaggagcccaacatgatgtttaaagccccttccctcatccggcagattgaagcgggtctagcctgtccaagtgaccactcagtgggaatctgcaagatacggtacagttgaagagatttcccacagcggatcggaccagcttgttaccgacatcgaaggatcaaaaagcgacgtcgctatgaacgcttggccgccacaagccagttatccctgtggtaacttttctggcacgacatcgaaggatcaaaaagcgacgtcgctatgaacgcttggccgccacaagccagttatccctgtggtaacttttctcgcacctctagcttcacacgtcgaaggactaaaggatcgataggccacactttcatggtttgtattcacactgaaaatcaaccgaccgtggcgtgcacgagggtaaatgtgggtcggtgcacctatgagagaggggcgcgagtgctgaaggcgaaagccgaaggcgctgcagcaaaccactcacagcgtctcgggtcaactgtaacaagctggtccgatccgctgtgggaaatctcttccaaagattcgatcattcactgaattctgcaattcacattacttatcgcatttcgctgcgttcttcatcgatgccagaaccaagagatccgttgcagcttattcgcaatgagatagatcgcgatccacatatacagaaccgcgagctactattcaaggtcaataacgtctgtacaattattgctcttcaacgaggaatccctagtaagcgcaagtcatcagcttgcgttgattacgtccctgccctttgtacccaccgcccgtcgctactaccgattgaatggctcagtgaggcgtccggactggcccagagaggagggaaaccaccactcaaggtgccggaatattgaccggcttccctttcgccacacggcgcaaagtgcgcctttgaaacggaacttccctatggcttcggatcgactaacccacgtccaaccgctgttcacatggaacctttccccacttcggtccttcaagttctcattgaagtattgagcgtctactctggcaccttaacctcgcgttcggttcatcccgcatcgccagttctgcttaccaaaaatggcccactactccgcgttcagttgcgttgccgcgcaaaacccacatccaggtgccggaatattgaccggcttccctttcgccacacggccgagcaaagcctatgaatagaacttccgaggagggaccatactatactacaaaagaattgtccgacggaccacagtatggttggttggttggttggttgtattcctactcggttttagccgccacttaacagcagccatgcccggctagtggggtttataaggctgccaatttggctgcccacggagctgcaatagatagctgtttacaaggcaggtctcaagaaggaacttccaggctaatgcccgccaatttcccttataaacccggtgttgcaatccctctgaagcccgaagttgatcaccgatatcaacacccaccacagcgtgcatgcaccaccacaaatccaaccacagcacatgcacatcgccgggaaccaaacttcagcacatgcacctcagccattatccagcagatggtagcttcgcggcactgcccggtcggacagccgcaaaaaccaattatctgaatgagcggtgagcaatggcagccggcgaaccatcaacattagccacttgagggaggcggtcatcgtgcggtaaggcaagtaactagctatgggtgcatcagtgcacagcaattttaacctctatagaggcaaggtttgaggcttgctgcagagcgagttaccctatactttcctaggcgggcgcctgatccggggcacacgaggcgcccggggcaatcccgccgaagcaacagtaggtatgttcacaggggtttgggagttgtaaactcggtaatgatccctccgctggttcaccaacggagaccttgttacgacttttacttcctctctatcccttctaatcgacggtctgtagattgaaggtacctctaatactattcaatggagtgcgaaaacgctaagaaaggccgtaactgtcccccgcccccggggttatatatatacattcatacgtgtctcctatattcaatctggtgggagtagggagctcgaccccggagaaggagcctgagaaacggctactacatccaaggaaggcagcaggcgcgcaaattacccaatcccgactatctgttgtcaatgcgagagcaggtgcattttacgttaacgatatcgccctgctccaagtcgagattcgagctggcgctactggggagatctgctcatcggagctctcaatctgtcaatcctcattgtgtctggacctggtgagtttccccgtgttgagtcaaattaagccgcaggctccccccctggtggtgcccttccgtcaatttctttaagtttcagccttgcgaccatactccccctggagcccaagcactttgacgcaaagaatccgaacgattcccaatattagcagttagctgtcgtacagttatatacaagtggacccggcgacatcatcccaaggctgacatagaacttgtcggtagagtccgaaacgcaaagaatccgaacgattcccaatattagcagttagctgtcgtacagttatatacaagtggacccggcgacatcatcgcaaggctgacatagaacttgtcggtagagtccgaaaatcctctcaaacgtccaagcgacgtgcttcagctattggttaccgtccttgtaatccatctcccaaaccccctacgcagccagccaccagggccgcctgtattggggaaatcgaggcgaaggccggcttaccctcagcagatcgtaacaacaaggctactctactgcttacaggaccgtttcgcacagctaagtcgtctgcatttccaactagatgtgaggcccttgtggatgaagaattccgagagggtgcacaaaggaggagtgttcaagagcgaaggggtgagggtcacacagaagcccgcaacaataacgcgagttttgtgttgaaacgcgtaagtttgccgatgcctagggcaaacaataattcactggagtatattggcagtggatgcctatgagagttcactcctctgcggcccagtatagggagaattggcgagtggtagtcacaaaatctccccgatttatcacatcgtacactatttcattggtcagttttacgaactgccaagccttcacaaacccctacgcgtaatgaaagtgaacgtaggagagagcttcggcgcatctccgaccgatcctgatgttctcggatgggtttgagtaagagcatacggggccggacccgaaagaaggtgaactatgcctgtatagggtgaagccagaggaaactctggcgaaacggtcctgtaagcagtagagtagccttgttgttacgatctgctgagggtaagccgtccttcgcctcgatttccccacctatgagagaggggcgcgagtgctgaaggcgaaagcctaaggcgctgcagcaaaccactcacagcgtctcgggtcaacggtaacaagctggtccgatccgctgtgggaaatctcttcaactgtaccgtatcttgcagattcccactgagtggtcacttacaactttaatatacgctattggagctggaattaccgcggctgctggcaccagacttgccctccaattgttcctcgttaaggacaactttaatatacgctattggagctggaattaccgcggctgctggcaccagacttgccctccaattgttcctcgttacgggatttaaattgtactcatctccgaccgatcctgatgttctcggatggatttgagtaagagcatacggggccggacccgaaagaaggtgaactatgcctctccgaccgatcctgatgttctcggatggatttgagtaagagcatacggggccggacccgaaagaaggtgaactatgcacaaagacatcgcagacgaagcgggcatttctatggaggagttcaagcgaacatttgaaaaagggaacatcttcacatccagcatttctgtcaagtatggaaacaatgtgctggttgacagcacggggaagcctgaggttgcatttcgcatgccgtttggctggatggtaggacatgagcgggatgaggtgggtgatggcttgattgtactgttggttgagcacagcttcggaagcggcaatttggctcggtgtcgcaaattcgtggcccatgaagagccaatgggtggtacccagcgcggtgatggcgtgccggatcaggggctcactcttatatatatatatatatatatatacactcagagggcaaacaacgcttgttcgtgccgagaatctctatcttcatagatgatcttcgttcttccgtccaatgacgattacatattaactagagaagatcataaggttggcattatcctgcacgtatatttgttcccgatgggtaaggtcctcatctaggatgccgtattttgccttcaggttgcgtacgagagtaaaccaaggtccgataacctttggatctttgcatttggccctctgatagtcatatttccgaacccagcgcgtatgaagctctggttgccgcttgatgaagttggaggccttatgtatactgttgtgggttgttttagtagggtaggtgccctgtaactggccgggtgcttgcatgatcatggtgagagggtctgggtgtgctatgtagtacctttccattttctggtcgaaaattccaaaaagtgacaaaccacgcccaataaagaccagctgttcctggtttctagctagtagacctggaagagagtaacacagagtacaaaaaacacgtattagagctaaacaagatagtggtgttaactacgcaagcctagcactaattaagaagtgtttacttgccgtagcagacggcatttttgcccttgcaagcaccacaacctggtgagtttccccgtgttgagtcaaattaagccgcaggctccacccctggtggtgcccttccgtcaatttctttacgtttcagccttgcgaccatactccccctggagcccaagcactttgatttctcgtaaggtgccgaacgagtcaatttttattgcggcgaggtcatcagtagggtaaaactaacctgtctcacgacggtctaaacccagctcacgttccctattagtgggggaacaatccaacgcttaccgaattctgcttcggtatgataggaagagccgacatcgaaggatcaaaaagcgacgtcgctgatcagcttaagagcctctttcagataaaagtgggtcttaaaaaggctatatatatcggtcgaacggtttggtggttgtaagttgattttttagatttcctatagtaatgaattttgcggaaaatcaaaagtggcccgggaagcagctttagcgggtagaagcccgtcaacgcctctcaaggaagcaggagaccgaattagctggatggatacgaattcaagatgctctcggcaatactccgtcgcatagccaggttattgcgatagcctcaactttgctccctccgtcagaccctccaatgcgtctgggaaagtatattctgaccaccacttcaaaaaaagtcatgtatatcggtcgcgcggtttggtggccgtgagtcgatttttttgatttccgctggcggcagccgttttactaggtcaactaccacagcctgtgtcgggttgaggctgtattcatcatgccttttcctcttccttgtacaaggcttgttctgacctacagagtcaaacaccttgtgaggcaggtgcggcagccacgagaggaaatagccggcttcagctacccccccccccccccccccccccccccccccccccccccccccccccccccccccccccccccccccccccccccccccggaatacccgctgaacttaagcatatcaataagcggaggaaaagaaaccaacagggattgccctagtaacggcgagtgaggcggcaacagctcaaatttgaaatctggcgcaagcccgagttgtaatttgtagaggatgtttctggcgacgtgccttccctttttaaccctcttttcaaagtgcttttcatctttcgatcactctacttgtgcgctatcggtctctggccggtatttacctttagttcataagatgctcaatttggcggccataggctgtttttaatgggccaaaaacgcctacatcaagtggctgaagaatatgagaggagtgaggaggcatacagagagccctggagccagggtgtttgtgaggttatagtcttccatgagctcaatgaggtcttccgcttctgcctctcctctagagatatccggacctccccacatctcgtgatatcccctaactttcgttcctgattaatgaaaacatccttggcaaatgctttcgcagtagttagtcttcaataaatccaagatcccctaactttcgttcctgattaatgaaaacatccttggcaaatgctttcgcagtagttagtcttcaataaatccaacaatttcacctctgacaattgaatactgatgcccccgactgtccctattaatcattacggcggtcctagaaaccaacaaaatcccctaactttcgttcctgattaatgaaaacatccttggcaaatgctttcgcagtagttagtcttcaataaatccaataatttcacctctgacaattgaatactgatgcccccgactgtccctattaatcattacggcggtcctagaaaccaacaaaatcagtagggtaaaactaacctgtctcacgacggtctaaacccagctcacgttccctattagtgggtgaacaatccaactcttaccgaattctgcttcggtatgataggaagagccgacatcgaaggatcaaaaagcgacgtcgctatgaacgcttggctctgaataattcctcattattataagctgtatcgttgaattcaacagtaacgtcaggtgagtaaagatacccttcgttttcaaagatctgaccctcgggcttgcgtcttgcacaccgtcccggcagagagtttgcccatcacaaccacgagccaagcacaaatctatctgcacatccagttcaccgtcagctatcccatgctgataggtcaactatcaacatctagaattaccacggttatccaagtagtaaggtactatcaaataaacgataacttatataatgagccattcgcagtttcctcgttcgttatcgcaattaagcagacaaatcactccaccaactaagaacggccatgcaccaccacccacaaaatcaagacgagtatggccaatcttgcattaacatataggaatcaaggccggtgggaggaggcagagaagcttgggttgcaggtgatagaggctcgtaagatgaagcttggagcagaaggaaggcagcaggcgcgcaaattacccaatcccgactcggggaggtagtgacaataaatactgatacagggttctttttgatcttgtaattggaatgagtacaatttaaatcccttaacgaggaacaattggagggcaagtctggtgccagcagccgcagaccacgccctaggggcatgagggttgaaatgacgctcagacaggcatgcccgccagaatactggcgggcgcaatgtgcggaagagcaataattgcaatgctctatccccagcacgacggagtttaacaagattacccaggcctttcggccaagggagtactcgctggctatgcttaagttcagcgggtattcctacctgatctgaggtcaaccttggaaagttgggggtttaacggcaggggctcgtggctctccgatgcggaatatcactacttcgcacgtgagcatgcgaatgtatcaatactagtgggccatttttggtaagcagaactggcgatgcgggatgaaccgaacgcgaggttaaggtgggtaaaactaacctgtctcacgacggtctaaacccagctcacgttccctattagtgggtgaacaatccaacgcttaccgcattctgcttcggtatgataggaagagccgacatcgaaggatcaaaaagcgacgtcgctatgaacgcttggccgccacaacggatctcttggttctggcatcgatgaagaacgcagcgaaatgcgataagtaatgtgaattgcagaattcagtgaatcagcgaatctttgaacgcacattgcgcccgccagtattctggcgggcatgcctgtctgagcgtcatttcaaccctcatgcccttctcaatactactgcttgacaaacaataaatacacaacatgcagttgaattcctttaactctgcacttcgcggaggaagagcgaaggtacgctttgcacctgtagccgtcctgggaccaatgacctgtcctgggaccaattgatctggtaaacgtgttaaacatcacggtggctgaaacagtagcgccattgcataccgcttgtagtagtccgtcccactacaatcttccagcgagcacactccaccagcccaatcggcaggggggaatctttcagcatacataaacacggtcatctcaatcagttcaggaaacatgtgttgaacgagcattctgattgtgtcgctagttgatgtcagcgaagcgttgcgaaacctagctttagaccatgccaactccgtcccatttcagagacattatctcgggcgagaagtcaacgcggatacatgggccattctccgaggtcaaaggtgcatgtctgggatggatctttacaatatatttattacggttgggcctcagattttatgtggaatgcccgagagctgatgaatcaggctaatagtaaatatatactatacttatagagataaattaactaataatcttatataactaacttttcttatttctaaataaattacaataatagaggagctgttttgatttaaataccatctgaaccggcaagcagtcgaacggatcagatgagatcatgcctaccgctttgttgaactgtatcggcttcctgccaccaatagtgtgtcttgaagggtggctgcattatgtataagacgagagagactgcgaccttgattagttaacgagaaaacttgtctcatttctacttcagtgtctaacttaccagcctgtctccttaaaaattaattatttaaactttatattatttttaattatatttagattagaatattagttttattagattagatttagtattaatatattaaagtttattttaatttaatttaaaattatatttatttagaaataaaaaaagttagttatataaagttattaattaatttatctctataagtatagtatatatttactactataaaagatttttattaaaaataatatagatttaatattaatctaatacttatttatatatagttatttatattatataatatataaaatatataataaatataataaaagaaatagaaactagatctaatttttaaagtatttttatataaatttaatagttatataactcttatagctattaataataagtaaatactagctagatcttaagagtttagttaaagggataaatatattttataactattctaatataattttattagaaatctatctttttttaaaaactataaaatactatttcttaaaagaatttaatttattaggaaattattattattaaactgattttcctttaaatataataaaaagcttaagatattaatctattatattaatatatttattatattttaaactagctataaccagcttagtattatagatagaatatttaaagttagctataaaatagctatagttagatagcttatagttaaaatctagatttataatatttttacttatatataaaataatataattcttaaagcttaattcttctctatttactaactatttctagctcttttataaggggctctatataatctctatttatagtataataagtactctaaataaagaaaaaaatactactattttaataatctagctatatttagcttattttaattaataaaagaaatttaaataaaaagtaaattaattactaattagctagtatatattattctataaagaaaatttaattattctaatttatttttatctactatatatctaaacttattatttttcttattatttttatatttaatctattctatatattttctttattataactagtactatttatcttttattcttttatatttctaaattatattacttactctattaattagtagagctttttaaaattacttttactttatatttaattattatctttagatttataactaactttattatagctagtttagtaggagttttctttaatagtattataataatttatttagttctactatataagattagttttttaaatagaattatattaattttatctatttctagctctattttcttattattcttagatataataaatagtttaaactatattataactactttcttcttagtaatagcttctttaaatatattaagtctaagctataaaatagtaatatttaactctataatagtattctttaactctaatataatattagctacttttagtattataatatactttttataattacttagtattttaaagtagttttaattaattattttataattagttatttctattttatattagagatctttattaatatatttaaaatatattttctatatataaatagtttttatttctattttagatatattcttaataattattaaattaatttaatttaaaaaagtaagtttaattattatctagctattaaagaaataagaattaatatattagagagtaagaatattaacttttactagaagttagttattataattctttatattatacttattataaatatatttaattctattctaaatatatattttaatagttatatctatctatcttttaatataataaataaaagtatttttatttatatagtttaactattattaatactaagtaaatccctagttgttttaaaatagaatctttttatatcttcttatagataataatctaaaatattatataatataaataactatatataaataagcacgccacctaacctatactttacataacctatactcaacataacctacactttacataacctatactcaacataacctaccataagcaactggaagtcagccatagcgtgtatcaccccgctaaaattccaaccccagcgcacccaacccactacataagcaaccacagcgcacccacaccaccacaaatccaaccacagcgaatgcacgccactgtaaattccaccacagcgtgcatgcataagcaactggaagtcagccatagcgtgtatcaccccgctaaaattccaaccccagcgcacccaacccactacataaccaaccacagcgcacccacaccaccacaaatccaaccacagcgaatgcacgccactgtaaattccaccacagcgtgcatggtttggtggccgtgagtcgatttttttgatttcccatacaaatgaattttgcggaaaatcaaaagtggcccgggaaccgacacggtgctgtgagctccatgacggcaatcattccgttgacggaagcggggtccgctgacaacggtaagggaaggagatatagcttgctctgttgaaacatcacgactggggggaatgtgtataagtatgggtgctccctccagtgtaaatcatgaatagaacaagtatttgaccccgctcgttttaaaattacaatacgcgaaatactacagcacacttctagtaccgtagagtaatcgcctgctaagaggcttgtacaaccgggcgggatcagggctgttgtaatcttacgagatcgtaggtcttgaagtacgtcgtcagtcgtatagaagctggctacatccatgaccaacatgtgttccttgccatccagaattacagctaattcatttgctatccaatgtctgacaacaacaacaacaacaacaacaacaacaacaacaacaacaacaacaacaacaacaacaacaacaacaacaacaacaacgtccaacaacgctagttcctggtcttccgccataagtattacagtcagctttcggttgatttactattaccatcgcaatgcccccgcaaccgcctcattcccatcagatccatattgaagtgccagccactctgcattagctggccaacgtaagcgctcagccgcacatggctttccggccctgagtggtggtttccctcctctctgggccagtccggacgcctcactgagccattcaatcggtagtagcgacggcagcggacaccgccatggttgaagctgtgcgctgagcactcctcttggggcgcccaagccgcaccggccctagtggtcctggtgtgaagcagaggggttttggagtcgaatacgcttcgaccaggatggtcgggttacagctgtgttgtttgcccacccagaatcgctagcgtacccaaaaagtgacaaaccacgcccaataaagaccgcatgctgtaccaaatcacgcaaaagacattgctcgatccaatgcatgctctcattccctcaggcagatccaagaaagacggattatagataaaccgaaaatgaacagagacaaggtcgctcgctagtcagtctgggtacctcttagtcatccataagctttgcgaggggaccaataggtacgcacctgggtgcgcacgtaagtgtcacgtgttgcgcacccggtgcgcgtgtaaggaagttatagttgttgtggttaaaaagctcgtagttgaaccttgggcctggctggccggtccgcctcaccgcgtgtactggtccggcggggcctttccctctgtggaaccctatgcccttcactgggtgtagcggggaaacaggacttttactttgaaaaaattagattgcacgtcagaaccgctgcgagcctccaccagagtttcctctggcttcaccctatacaggcatagttcaccttctttctggtccggccccgtatgctcttactcaaatgcggacctcgtgtccactatagcgctcgcattagcggacctcgtatctgctgtacgagaaccttacagcggttacgagcccgtatctgatgagcgtctactctggcaccttaacctcgcgttcggttcatcccgcatcgccagttctgcttaccaaaaatggcccactcatgactttttttgaagtggtggtcagaataatcagcttcgcgagctctttgaaatactggccttctcacttccctccgctccgcgtggaaggcgggagaccggtttgaagttggggtaccgggtaggcagaaaccacaaccagctaccctatacccggcaccgcccgtcgctactaccgattgaatggctcagtgaggcgtccggactggcccagagaggagggaaaccaccactcatggccgatccgttgttgaaagtttttatttatttgtaaaaactactcagaagattccaaaataaaacaagaattaagtttcctaggaaaactactcagaagattccaaaataaaacaagaattaagtttcctaggcgggcgcctgatccggggcacacgaggcgcacggggcaatcccgccgaagcaacagtaggtatgttcacatgggtttgggagttgtaaactcggtaatgatccctccgctttttgatccttcgatgtcggctcttcctatcataccgaagcagaattcggtaagcgttggattgttcacccactaatagtgaacgtgagctgggtttagaccgtcgtgagacaggttagttttaccctactgatgacctcgccgcaatggtaattgagcaagttacggatctattttgccgacttcccttatctacattgttctatcaaccagaggctgttcaccttggagacctgctccgtccggtgccacgccagtcgttgcaagtagtatcgcgaccaccgcatcgttcccgttcctcgcggcccaccacaacggtatccgaccatagctactctgggagtctggattaataacgtttgttgcaagtaatagcctgaccactgcctcatgcccgttttctgacgcaatcgatagcggcgcctggccgaattcgtcatagagcaatgttgacacttcttgtatgtgctgagaccactcttcaagatagctgtatggctttggaagggttgaatccgggctatttgggcagaattctcaaactttaaatatgtaagaagctcttgttgcttaattgaacgtgagcattcgaatgtatcaatactagtgggcgattgtgcgggatgtaaagatagactggctaccctgcagccgcttcccgagagacagaccgggcgccagaactctggcgtcctggtaatccatctcccaaaccccctacgcagccagccaccagggccgcctgtattggggaaatcgaggcgaaggacggcttaaactgcgaatggctcattatataagttatcgtttatttgatagtaccttactacttggataaccgtggtaattctagatctaatacatgcttaaaatcccgacttcggaagggatgtatttattagattaaaaaccaatgcccttcggggctctctggttctttagattttaatagtttaataatataattaaagaatattaattactataattattctagtattaaaactagtttaaattctttatatagtttatattatatagatttaatttatatatatatattatattttaaaactatagtttatatttctttttataaatctagataattataatattatttcgtgagggtcgacgcccactatgaatcacccgccagcgaagccgaagccgtctagcctgtccaagtgaccactcagggggaatctgcaagctataattattaattacttaaaataggataatatagatatagattcagaaccagaaattttatctccatcagtccctatgcccggtatataataaatatagtcagtaaatagctatattagattacctcggataatagttattattactttaagggtcttattagaagtattaaccaggccctaagaggttagaatatttataacactcgcatacgaagacgactccttggtccgtgtttcaagacgggtcgttgatgaccattacgccagcatccttgcagcgcgcgaacctcagtccaccccagggtattacacagtgggctataacactcccgagggagccacattcccaaagcctttaggtggtcgtagcaaatacttcaatgagaacttgaaggaccgaagtggggaaaggttccatgtgaacagcggttggacgtgggttagtcataaatcgccagcacgtcaactattttggcgcttagatccagttacaatacacatcttagagcacgatagaaaggttctggaagcttttaagactctggtacctgtttcccccaatagttatagcctcctcctataattaaagaatattaattactatagttattctaatactaaaactagtttaaattctctatatagtttatattatatagatttaatttatatatatatattatatgtcagaagcgttgaccgggccctgagaggttggaatatttgtatcagacattatggctgtgagcactcgctaggtgtctagtgattgattgattgaacgattggtgcttcgagttggaaaggaaaggtggttgttgctgttggggctcacgccctaggcttcgtcactgacctccacgtccgcctactcctcagggcatcgtttctaccctgagggcgagggatgggtgagacgcttgagcgccatccattttcagggctagtacattcggttggtgagttgttacacagtccttagcggaacttttactttgaaaaaattagagtgctccaggcaggcctttgctcgaatacattagcatggaataataaaataggacgggtggttctattttgttggtttctaggaccgccgtaatgattaatagggacagtcgggggcatcagtattcaattgtcagcgaaggttttggtggttgtgagttgattttttagatttcctatagtaatgaattttgcggaaaatcaaaagtggcccggtgtgacggttgggcaacttacactggacggggtctagggtaagtcggggttgaaccaatcagatgttgttctgagtgctagtggctgcctgctcccgaggcgtcctcccaaagcccaacgtacccaacccttagagccaatccttatcccgaagttacggtaatgtattcgagcaaaggcctgcctggagcactctaattttttcaaagtaaaagtcctgtttccccgctacacccagtaaaatccgcgggaaggaataattctcacgccaggtcgtactcataaccgcagcaggtctccaaggtgaacagcctctggtggatagaacaatgtagataagtttgtggtggtgtgggtgcgctgtggttgattatgtagtgggttgggtgcgctggggttggaattttagcggggtgatagacgctatgacacccgaacactcgcatacgaagacgactccttggtccgtgtttcaagacgggtcgttgatgaccattacgccagcagccttgcagagcgcgaacctcagtccaccccagggtattacacagtgggctataacactcccgagggagccacattcccagaaagctggctcactgtcggttttgccgcccggatagctatggctcaaggtctccatatcgacggaactcattggaaattaccaggggtggagcctgcggcttaatttgactcaacacggggaaactcaccaggtccagacacaatgaggattgacagagtgaacaccaaaacggcatcgcgtgcgttccacactctatcatcaaccaatgatccaattcaaaccctcgtttttcggcgggggataatgtgcagaaaacaacgggctggcgaaatctcataatgcggattgtaattggagaagatgggcgaactccctggagagctttccggccctgagtggtggtttccctcctctctgggccagtccggacgcctcactgagccattcaatcggtggtagcgacgggcggtgtgtatctttactcacctgacgttactgttgaattcaacgatacagcttataataatgaggaattattcagatattggatagtaaatgaattagctgtaattctggatggcaaggaacacatgttggttatggatgtagccagcttccatacgactgacgactattatgttaaaaggggagagacaaaagcatttttctattctgttggtggcgacactgagaaagtaaccgcaaatagggtatacgccgaaaggtgcatggtgggaaagccaaagcatccttgcagagcgcgaacctcagtccaccccagggtattacacagtgggctataacactcccgagggagccacattcccagcatccttgcagagcgcgaacctcagtccaccccagggtattacacagtgggctataacactcccgagggagccacatgcccaaagcctttatcccccggggcgaactgatgctggcctgggcaggcagagtgcaccgcggagaaccacggatgatcacgctcagttactgggccaagtacgtgctgcagcgacatgggggccgatttgccacccatcccgtcttttgctttcttgttttcaacatccttctccgttcttctaaccgacgaatcagcgcttggtgtagtactcgttgagtttctgccatgcggtgatgattgagagtctcagatagcgtcggtggtcctttcccataccgtcagttcccaatgatcccgatggcttgcccgatccatcatcacactgtcccgagccgcgacctggcaaggagctttcttaccctgctggaccagcgccgacaatcaaaagatcaatattttccaccatagcgacttctagcgagcaagcacgacttcctgactcttcgtcagtgtttcctccgaaggacaattattcactggttcaaatattataataatctgccttgtacgatgagatctaccgactccgcgctgcataatgtgtggtttgcgaggagggccaattaggaagggtcgaaaacgcacaccgcgttcatcggcttctgggatatcagggcgataggtgcagtcaaccggctgctcgcgtcagctgttaagtagagttcagaagtaatagcaatgctacaccaagatgatgtaagaccctttgcgtctatcaagcatccggtggtttcctttctattgtcgcccggtagcgatgccgcatgagagttggtcaaagccacaagtaattttgatactgaagcctccatttgcagccagcggctcaacccacatccaggtgccggaatattgaccggcttccctttcgccacacggcgcaaagtgcgcctttgaaacggaacttgcctatgcgtgtgttgtgtgtgaatatgctttggtggcattcccagtgaggtgcatgtgctgaagtttggttcccggcgatgtgcatcgtcagacagtcggcatcatcctgcgctaacgctaagagtatagccagaatacctatagcatccgtcgccagcggtagcgccagcatcttcagttcctctcctccttccacctccaattcctgctaaattattttgatttatttttcgtacgaaatatgcgtgcctataaaaataaaagaagaataaaggtttttaaaagaagaagtaaatttttaagaagaatatttataagtaatgtagaaattaaacatactaataataaagcaaaaataactttatatacaaaatacaggctttccagcgggaattagccggatatagcagtaagagcgctgtaagttagtgagccgggctcataacctgtccccttgccgccgtacttcctgtacatcgccctgaagcagctgatcctttggcctcaagaaggtccagataggccgcttacctcggccccttacgacaccgcattcatcgctccagataacacagttccagtcaatatccttatactgttccgcccaggaaggtggaaggccaggaacccgcgttcaaactggtcgggaatatcctgcactggtcctccacgaagtgcaaacgcgtcacacgaagcagcctcgcgtcagaagtctatgaacgataacttatataatgagccattcgcagtttcgccgtataattgcttatacttagacatgcatggcttaatctttgcgacaagcatatgactactggcagaatcaaccaggtaactatcgttcgccggggttggccaccagcgcccacgaggggcaccttgtcacttatccagcaatttatccctatttcgctagttgagaaatgggtcaggtacacgaatgaagctcctgacccaggcccggaaggcccatcgcagcagaattcaaggcagcttgattggaagccaacgacaaaagcaagttgggacaagacttacaatacaagataccgagttgtaagctcctcgtcaaaatccatcagcgtatcaagcctaccttctaacaagtagaggcctagtagagtcaagagaccatcaaaatgggtttcggcagttgccatattgccaaaacagccacatgaacttgtatcccaagtggcgccttcccgataatgcaagcgaagaggtgttggaagacctcatcgacaagatgcagcagaatacgctcagtcttattacagacaagcagccgtctggaattaccgcggctgctggcaccagacttgccctccaattgttcctcgttaagggatttaaattgtactcattccaattaagtttattttaatttaatttaaaattatacttatttagaaataagaaaagttagttatataagattattagttaatttatctctataagtagatgcccttagatgttctgggccgcacgcgcgctacactgacggagccagcgagtactcccttggccgaaaggcctgggcaatcttgtgtaaaactaacctgtctcacgacggtctaaacccagctcacgttccctattagtgggtgaacaatccaacgcttaccgacttctgctgctccaggcaggcctttgctcgaatacattagcatggaataataaaataggacgtgtggttctattttgttggtttctatgaccgccgtaatgattaatagggacagtcggatttcgcaccatggccttgacgactgaatcagcttcgacgtatgccgttggcaagcctatagataacgactttgacttagctctgacctataatggtgggttcacggatccctttacaaatgccgaccgtatgatggtggatccccgcctagcaatgccgctccctatcaacgtctgcgccttggtctccttttgcgccttggtctccttttgcgccttggtctccttttgcgccttggtctccttttgcgccttggtctccttcccacctattctacacctcctatgtcttttcacaatgtcaaactagagtcaagctcaacagggtcttctttccccgctgattcacttggacaggctagacggcttcggcttcgctggcgggtgattcatagtgggcgtcgaccctcacgaaagcggccgcgggcggtacgtcgtactgaggatgcctggtctggggagagctctgctctcgccggcgctggatgggttctgtggatggatgatggttccaagagacacaaagttaacatgtctacaagacagtcggctaacatctctagccagtagagttgaatttagagcggacctactatagaacagagaatagttccaggcgccaagaaggtcgcgcctccaaccactggacatgattaccgtatgacccggggctatatattgccttcatccattctcaaactttaaatatgtaagaagctcttgttgcttaattgaacgtgagcatttactttcccagacgcattggagggtctgacggagggagcaaagttgaggctatcgcaataacctggctatgcgacggagcacgcgaagctgattattctgaccaccacttcaaaaaaagtcatgtatatcggtcgcgcggtttggtggccgtgagtcgattttttctaagatactggagaaggagatgtgcgggatgtaaagatagactggctaccctgcagccgcttcccgagagacagaccgggcgcttttaaaaatagtatatagtaatttttataattagctattatttttcttttaaagattttataataataactaattaatctactataattctaaatactattaaattaactttatttaatttaacttttctatctaataaactttctaataattctatttgtggctgggatagagggatgtctagtcgatccgcgcattgctacatgtactcgagccgccggaggaaaaggggtgtgcgctcttgaccgtctggctttcagctgtcttcgccacagacctcctcgcgctactctctgaaaggaccaacaataaatactgatacagggttcttttggatcttgtaattggaatgagtacaatttaaatcccttaacgaggaacaatgggagggcaagtctggtgccagcagccgcggtaattccagctccaatagcgtatattaaagttgttgtggttaaaaagctaaagaaggtgaactatgcctgtatagggtgaagccagaggaaactctggtggaggctcgcagcggttctgacgtgcaaagcgatcgtcaaatatgggcatgggggcgaaagactaatcgaaccttctagtagctggtttccgccgaagtttccctcagggttacggatctattttgccgacttcccttatctacattgttctatcaaccagaggctgttcaccttggagacctgctgctgttatgagagatattgaatatcttatctttaaagctgaaggaattattcaagatctaagacctagtctagggtaggctggttataggttagatcgtctgagaatatcctaggatttttcccggggtgttggggatcggccaaagcccgcgagggacggccggcccctaaatctagtggcggacccgtcgtggcctcctctgcgattctaattaattctagaatttagatttatagctatagtttatatatattagtaatagttagattaattcttatactaagctattatatataatctgctgttcctggtttctagctagtagacctggaagatagtaacacagagtacaaaaaacacgtattagagctaaacaagatagtggtgctaactacgcaagcctagcactaattaagaagtgtttacttgccgtagcagacggcatttttgcccttgcaagcaccacaaacatacctactgttgcttcggcgggattgccccgggcgcctcgtgtgccccggatcaggcgcccgcctaggaaacttacttcttgttttattttggaatcttctgagtagtttttacaaataaataaaaactttcaacaacggatctcttggttctggcaattactgtgttaagggtcaggcccatgggccattttggcataggtcgtccatcatagagagtgaggatgatgataagggtaaggaacagcaggaccgcaagaaagctccaaattatctctccagcccaagcttccagggcagcaggtctccaaggtgaacagcctctggttgatagaacaatgtagataagggaagtcggcaaaatagatccgtaactaactaacctgtctcacgacggtctaaacccagctcacgttccctattagtgggtgaacaatccaacgcttaccgaattcggcttcggtatgataggaagagccgacatcgaaggatcaaaaagcgacgtcgctatgaacgcttggccgccacaagccaggaaaatggaaaggtaccacatagcacacccagacactctcaccatgatcatgcaagcacccggccagttacagggcacctaccctactaaaacaacgcgtgtggacattgtcattgctaatgcgggtatcatggaaagtcataaatttttcgacttccaaacgaacgaggcaggacgcttgatagacgatggatcaagccgggtcatcgatgtgaatctcaagggaacaatgaacagtgcgttccacaagccattttatacctctcgtatctgctgtacgagaaccttacagcggttacgagcccgtattacagaaggcaacgtgttatcttcagggctcttagagctctgactccagtagaacaaaagggtaaaagtccccttgattttgattttcagtgtgaatacaaaccatgaaagtgtggcctatcgccagacactctcaccatgatcatgcaagcacccggccagttacagggcacctaccctactaaaacaacccacaacagtatccagacactctcaccatgatcatgcaagcacccggccagttacagggcacctaccctactaaaacaacccacaacagtagacataagcaactggaagtcagccatagcgtgtatcaccccgctaaaattccaaccccagcgcacccaacccactacataccagacactctcaccatgatcatgcaagcacccggccagttacagggcacctaccctactaaaacaacccacaacagtacacataagcaactggaagtcagccatagcgtgtatcaccccgctaaaattccaaccccagcgcacccaacccactacatagttggacaggggcgatgtcctgcgacagcctcggacttttctcggggcggtgaggtctcgtggctggcggagtcagaaggccccctggttgtgcgtcgtcccgagggcgctttcgggaaggcggggtctgtggggttgccgatgacatcggggcttgagagtcgaggacagtggctagatacagggagggccggtctactgagcgtgagctacaggcggtgagatagcctgtggggtggaggttatgtgaggtgcaggttatgtaaagtgtaggtcatgtgaggtgcaggttatgtaaagtgtaggttatgttgagtaaggttatgttgagtataggttatgtaaagtataggttaggtggcgtgtgttgtgtgtgaatatgctttggtggcattccgaggctctcaccctctatggcgtcccgttccagggaactcggaaggcacgtcgccagaaacatcctctacaaattacaactcgttcgacaacctatacccccagctaccgatcctcgaccgtaactctgtggaacagcaggtgctttacatggagcagaaccgtggcgcctactgcctgttgacttcgctctgtgccttcgctctcaccctctatggcgtcccgttccagggaactcggaaggcacgtcgccagaaacatcctctacaaattacaactcgggcttgttatttctggcgctgtctcattggtcaaaagcggaaaaagtgacatggctggcaccgcatcgcacccaaagggataggtataggcggatttaagagttggcgcgagaggcagctaatttgttgttgcagatgaagtggggcacaagaagtgggccaactaagcgtctcacccatacctcgccctcagggtagaaacgatgccctgaggagtaggcggacgtggaggtcagtgacgaagcgtagggcgtgagcccgggttgaacggcctctagtgcagatcttggtggtagtagcaaatacttcaatgagaacttgaaggataggtgatatggtgtcgcggcccatggctgttgctggcacagaagccccacagctcttcggtcttgacggggagggtctgtggtgcggaaatcgcagggcatctctgccttagcacatcgagtactgttctataatcagttgacatgaataaccatgttttccgacatctattagtgagctacgcttaatgaccacacaaaaatcagccaagcccacaatattaaaccgcgtcaaagccagtctgcccccccccccccccccccccccccccccccccccccccccccccccccccccccccccccccccccccccccccccccatcacctgcaactcaagcttctctgcctcctcccaccggccttgattccaatatgttgatgcaagattggccatactcgtcagtgtaccctgttgagcttgactctagtttgacattgtgaaaagacataggaggtgtagaataggtgggagcttcggcgccggtgagtagaccacacaccgatttgaaagttaacccagggacatgggcatccagcccaatacttcggccttcattacttcataatcttggagacttcctgcctagaattgacgcaatgaggccacttgaaggtgctggatacagatctcttcatatcaccacagattagccggcccccctacctacggtagggggggtcagcgactagcgaaaaagacagcgactcgcaaaaaaaaaagtgacttcaatttagcgggccccgccaagtgaggcgtccggactggcccagagaggagggaaaccaccactcagggccggaaagctctccaaactcggtcatttagcggaagttcacccgccagcgaagccgaagccgtctagcctgtccaagtgaccactcagtgggaatctgcaagatacggtacagttgcagagatttggtgtgatgttcacccttactctttgtcaaactaatcaaatctctccaccaagtcttatcgttagctgcataggtatcagaggctctctcctacgttcactttcattacgcgtaggggtttgacacccgaacactcgcatacgaagacgactccttggtccctttgtatgggaaatcaaaaaaatcgactcacggccaccaaaccgcgcgaccgatatacatgacttttgtaaacccgccagcccatctctttccgctcctggcggagagtctttccagcgtcctcatccaagcactcgtgaaagaccgagtctatgtagcgtagcacccgagcacgatactcttcctctcgagggtcggcgatgttgtcgatgagtgacggcaactccatgttgccgtgcaaccacaggacccggtaccccaacttcaaaccggtctcccgccttccacgcggatcggagggaagtgagaaggccagtatttcaaagagctccaatagcacggcattgattggacactattgagtcaaaatctatttttgctgcttatctgctgacctatttactactttgttcgctataaaagtccccttgattttgattttcagtgtgaatacaaaccatgaaagtgtggcctatcgatcctttagtccttcgacgggtgaagctagaggtgccagaaaagttaccacagggataactggcttgtggcggccaagcgttcatagcgacgtcgctttggatcttggcaagtggcccctcaatcagctctgtggctttgcaaccacgttgtgcatggaatgaaagagcctacattttaataattagtccattttcattgcaggaagtgctataatgccaatacgtacagacgaactgaacgaccctagggctttaccatccgtctaagatttcggacatactagccttgctggaagttatactatacttatagagataaattaactaataatcttatataactaacttttcttatttctaaataagtataattttagattaaattaaaataagattcgatgattcactgaattctgcaattcacattacttatcgcatttcgctgcgttcttcatcgatgccagaaccaagcgatccgaggcccggccggaccagtacacgcggtgaggcggaccggccagccaggcccaaggttcaactacgagctttttaaccacaaggcccggccggaccagtacacgcggtgaggcggaccggccagccaggcccaaggttcaactacgagctttttaaccaccacaactttaatatacgctattggagctggaattaccgcggctgctggcaccagacttgccctccaattgttcctcgttagtaagttgaatattattttctataattaaaaattttgtaagtactaaagcaccaatatctcataaatatttaaatcacggtacattaatagaattaatatgaactataacaccggctgtaatattaatattaatagctttcccttcatttaaattattaatatattctaagattaaataatatataatctaatatatattttttaagaatataattaatagtttatatctaaacttttaatattataaaataaagttaaatattatacttttagtctaagtataaatattaatatcttaaaaactctaataatagaagctatttatataactagatatatataaataatctagttataactataacctctaaaagagaaagcttattatctaatagtaataactatcttttctttctaacttaaagtactaattacttaattaattaccctccgttacccgttgcaaccatgtttggccaatacccaaacatcgaaagttgatagggaagaaatttgaatgaaccagcgccggcgcaaggccatgcgattcgagaagttatcatgaatcaccagagagccccgaagggcattggtttttaatctaatttgaaagggggtattgatgataataagtatttggtgggtattccatttgcttggaagcagggagggacggtttgctgacaaaagattaaaatccagatggagcgtgtcattcagctatttccaatgagttccgtcgatatggagaccttgagccatagctatccgggcggcaaaaccgacagtgagccagctttccgttatacgctgggagaagaggcaataccgagttaccaatatgccagcccggacgaggtcagtgctttcgccatagaaggcctcattgtcgcctcaaccatctgatatggggttgccgggggatctccccttcgtacaggatccacctggggcgggggcatcaccaacgggtgatgaagtcgtccatcacgaacggccgaggcctgcttcacgtctcgaagaggaaccggtatagctgaatttaaatataattaaaaataatataaagtttaaataattaatttttaaaaactatttctattctaattaatttaatataagtttaagttctctatatagtttatattatatagatttaatttatatatatatattatattctgaaactatagtctatactagattccccttgtccgtaccagttctaagttggttgttaaccgtacgccggacggccgaagcctgctaagggcatcagcaccaatgatccctccgctggttcaccaacggagaccttgttacgacttttacttcctctaaatgaccgagtttggagagctttccggcggatctattttgccgacttcccttatctacattgttctatcaaccagaggctgttcaccttggagacctgctgcggttctgatgcagcagcggaatctgaatctccgtatcatagttacgggcaagcacgtcgtccatatcggcgttgggcgtggtttgtgcgccaccctgtggacctgtctcaatctcatctagcatccaagatctgcactagaggccgttcaacccgggctcacgccctaggcttcgtcactgacctccacgtccgcctactcctcgctggtttccgccgaagtttccctcaggatagcagtattgaactcagttttatgaggtaaagcgaatgattagggaccctggggctatatattgccttcatctttattgggcgtggtttgtcactttttggaattttcgaccagaaaatggaaaggtactacatagcacacccagacacgctcaccatgatcatgcaagcacccggccagttacagggcacctaccctactaaaacaacccacaacagtatacataagccagtcagattccccttgtccgtaccagttctaagttggttgttaaccgtacgccggacggccgaagcctgctaagggcatccagtcagattccccttgtccgtaccagttctaagttggttgttaaccgtacgccggacggccgaagcctgctaagggcagcagcacccaggtgctggctgccgccggccggttgcccggctagtggctgcctgctcccgaggcgtcctcccaaagcccaccaattcttgatggaatcaataagattgcaaagggtacacagcgtgttatgcatgaggtggcaatcctacgtgaggagggtgctactcttcggaaggcaaatgaggcactaagcaagcgccggagagctaaaaaaacacgtctacgacaaggaggatcctcgccggcgcaaggccatgcgattcgagaagttatcatgaatcaccagagagccccgaagggcattggtttttaatctactacgagtagtttgggaatgctgctctaaatgggaggtatacgtcttctaaagctaaataccggccagagaccgatagcgcacaagatagcacacccagacactctcaccatgatcatgcaagcacccggccagttacagggcacctaccctactaaaacaacccccaacagtatacataagcaactggaagtcagccatagcgtgtatcaccccgctaaaattccaaccccagcgcacccaacctcattctcagatgttctggggtgcctttggttggaatattcgtacatctttggtgccgcttcttggagacccggacagcacaaggggcagtataaccggccgtattattcgggattaccttgaggaaaaccttccaataatagtatctccgagaagtatatttatacaagataatgtatctacatatacagcccgggttatacagaattggcttcgtaactgggctgaagagcatagggttgagctgcttgactggccaccttacagcccggatctcaaaatgctcacgttcaattaagcaacaagagcttcttacatatttaaagtttgagaatggatgaaggcaatatatagcccccgaatgctcacgttcaattaagcaacaagagcttcttacatatttaaagtttgagaatggatgaaggcaatatatagccccaggaacggccatgcaccaccacccacaaaatcaagaaagagctctcaatctgtcaatcctcattgtgtctggacctggtgaggacttcatccggcggctacaggcacggcagctgctggaccgggtggttatggacgagtgccacgtggttctggacggagtcgggcggttccggccagcgttggcagcactgggggggatcttgcaggttcccgggccagttttgattttccgcaaaattcatttgtatgggaaatcaaaaaaatcgactcacggccaccaaaccgcacccaggctcatgggagggcgtcccgcgggcgctgcagggtatgtaaaatcaaaaaagttgttaagagccgcggtaaattacccaggctcatgggagggcgtcccgcgggcgctgcagggtatgtaaaatcaaaaaagttgttaagagccgcggtaaatgattgttttagagggtgggaagcgctgtaagtcgaggacagtggctagatacagggagggccggtctactgagcgtgagcttctaaatataatatatatatataaattaaatctatataatataaactatatagagaacttaaattagttttagtattagaataactatagtaattaatattctttaattattaaatattatatagtataaataactatatataaatagatattagattaatattaaatctatattattcctaataaaaaccaagtcatacaaccgatgaatttatgatcaaatgcttccagaatgatatattccttcttttcttaccttcgcattcatcgtacgtattacagccgcttgatatatcagtctttccgcgggacgccctcccatgagcctgggtactcttcagaaatacaccggcccacatttaccctcttgcacgccacggtccgttcccgggccagttttgattttccgcaaaattcatttgtatgggaaatcaaaaaaatcgactcacggccaccaaaccgcatgatcatgcaagcacccggccagttacagggcacctaccctactaaaacaacccacaacagtatacataagcaactgcaagtcagccatagcgtgtatcaccccgctaaaattccaaccccagcgcacccaacccactacataatcaaccacagcgctgagccgttccatctgcagaccatgagaacgcaggggtggggtagcgagggaggtaatggacgactttgggaggtgatggcaggcatgggatacttgctagaacacctagaagatcggaagctgttctatcaggctgccccagacgaggcagcaggggagcgccaacgggccaccgttgaccgtctggtggatcgttttctacacgatgtgagcttgcccatcgacgccgttcatccgccatctttccggcaggaatatgaacgtttctacagccggaaagccggtttagatgacgtgacgactgtagatatccgatggcaccgcgcgaccgatatacatgacttttgtaaacccgccatcccatctcttctaagctaccctgaaggctatatcgcctacgatataccgtgacgttgaaggtgccgaggaggagttcatgaagatgcgatacacagctgcgacctgcgaccccaacgactttgcgctcaagaacgggtacgatttgcgccctcgcatgtacaatcgccaaaccgagcttctcatcaccatcacctactacaagccgttttggtgtcaagaagtttcctgggctatatttaattagaaacccaaggatgacttaactggggaaagagcgcgcgacgaaacttgacgcaaaaagcaagctagtgcaccataggtcggctgtctgtagaacagatcgactaacccacgtccaaccgctgttcacatggaacctttccccacttcggtccttcaagttctcattgaagtattttcccaatcctcggcgaactgtcggagcacctccatgtcggaggccgtagctgtcttgatgctaagatcaccgctcttcagctggttagtggacgcagtcttgatcaagtttcctaggcgggcgcctgatccggggcacacgaggcgcccggggcaatcccgccgaagcaacagtaggtatgttcacagggacgtcgagagcgcaccagacccagcagaggtgctgggctcttccggccattaaaccctagctccggacaaaccgatctcagggtgatagaccgttaagaagaaaagagaactctgcctggggcccccgcgtaatctgtggcatagacctttccctcaaccgacgcccaagaccaagatggacagcgatagtcacttggtctggtgtgactgtcttcttcggaaacccgccatcccagttcccacccgagatgccgcctccaaagcccagcaagatagtcatctttcaagttatagcgaacttccctgctgcgttatagcggtctcaaggcccaatacaccttgaaggccactgtaatttcaacagaagttaaaatggctacttctgggtctaagggaaaacaactcttagagggttcctataaggttccttctagtcctataactctagacgtttatcataatcaggatttatatactccgcacccgacaaaacctggtcatgttcgttgctgtggcagaaaggacgacttgttgaaacttacgtggctggccaaggtccgatgatacctatgcagctaacgataagacttggtggagagatttgattagtttgacaaagagtaagggtgaacatcacaccgagtatggtcggaagggatgctggtgtaaccgaggacgagaggaaccgctcattcagataattggtttttgcggctgtccgaccgggcagtgccgcgaagctaccatctgctggttattagaccttggtttactctcgtacgcaacctgaaggcaaaatacggcatcctagatgaggacctatacaactttgatgagaccggctttatgatgggggttatcttccctggaatggtggttactacctcagagggtcgtacaaaggctaagctagtggcatgtcatgtcctgcctacacaagtacaagagaccaatgcgtactagctccactcatcctcgctatcctgtatctccaccttcctctcgctctcctgtacctctgtgtcattccccccatcccgtgcctcagtgtccggcctgatggcacccttcaggtccccgagacgctgtgagtggtttgctgcagcgccttaggctttcgccttcagcactcgcgcccctctctcataggtgcacccacccacatttaccctcgtgcacgccacggtcggttcccgggccacttttgattttccgcaaaattcatttgtatgggaacccaacccactacataatcaaccacagcgcacccacaccaccacaaatccaaccacagcgaatgcacgccactgtaaatcccaccacagcgtgcatgcaccaccacaaatccaaccacagcacatgcacatcgccgggaaccaaacttcagcacatgcagcattatgaaaggcatgggggattgcgtcagctagtctcctcgagaagtggcatctaaccatcaggagatgggcatcttgtcccttccattatcctggtgctgcactaccgctccctcctgcagctagcggcatcccggtgtaaaattccatgtcctactcatagtgtacgcattatgaaaagctacaggcggtgagatagcctgtggggtgcaggttatgtgaggtgcaggttatgtaaagtgtaggtcatgtgaggtgaaggttatgtaaagtgtaggttatgttgagtataggttatgtaaagtgtaggttatgttgagtataggttatgtaaagtagaggacagttctttgaggtcattatgtggccaacggcgtgacatttgctgcatttgcttggggctctcctggtgccttcgactctctcaaaaccagagggctcacgccttgtgaagcaacagtaggtatgttcacatgggtttgggagttgtaaactcggtaatgatccctccgctggttcaccaacggagacctcggaaggctgaaacttaaagaaattgacggaagggcaccaccaggggtggagcctgcggcttaatttgactcaacacggggatattacttcccctactattagggcatatcgttgaaccaaaaaataaccttacgtgctgtaattaagtatataaaacaagtacagatttaagccttttccaatcacttttctgcacgcacttgtgtaatccaattaatccaagcacttcacaacagttactttgtagcgagtctgttggtgttgcggctccacaggctgcaagagatcgcaagaggaagcggcccggaaccttagctctcaacccgacccaaagtgtcgtggttgccctagtaaatcagctgccaaaggggacattccacgtcttcattgataacctatttacctctgctgacctctcttcgacgagtcgagtagtttgggaatgctgctctaaatgggaggtatacgtcttctaaagctaaataccggccagagaccgccctaaccctaaccctaaccctaaccctaaccctaaccctaaccctaaccctaaccctaaccctaaccctaaccctaaccctctcctacgttcactttcattacgcgtaggggtttgacacccgaacactcgcatacgaagacgactccttggtccgtgtgtcaagacgggtcgttgatgaccattacgccagcatccttgcagaaaaagtgtgccctcttcatgtacctgattatcactgtgcgtcgaatcaacccctctcaatccgacagcttcttgacgacgacttttctatcatcgtgctgccagccagccccgttctcgaccgggccaatgatgagatcgaagtcgtcacagaccctcggttacaccagcatcccgatatacatgacttttgtaaacccgccatcccatctcttctaagctaccctgaaggctatatcgcctaagatactggagcaggagatgtgcgggatgtaaagatagactggctaccctgcagccgcttcccgagagacagaccgggcgccagaactctgttggtggccgtgagtcgatttttttgatttcccatacaaatgaattttgcggaaaatcaaaagtggcccgggaaccgacaatttatctctataagtatagtatatatttactattatagaaggtttttattaggaataatatagatttaatattaatctgatatctatttatatatagttatttatactatatatcaggcgcccgcctaggaaacttaattcttgttttattttggaatcttctgagtagtttttacaaataaataaaaactgtcaacaacggatctcttggttctggcatcgatgaagaacgcagcgaaatgcgataagtaatgtgaattgcagaattcaggcaaatgctgtcgcagtagttagtcttcaataaatccaagaatttcacctctgacaattgaatactgatgcccccgactgtccctattacggtctactgagcgtgagctacaggcggtgagatagcctgtggggtgcaggttatgtgaggtgcaggttatgtaaagtggaggtcatgtgaggtgcaggttatgtaaagtgtaggttatgttgagtataggttatgtaaagtgtaggttatgttgagtaaagggcatcagcacccaggtgctggctgccgccggccggttgcccggctagtggctgcctgctcccgaggcgtcctccccaagcccaacgtacccaacccttagagccaatccttatcccgaagttacggatctattttgccgacttcccttatctacaacaatcttagaggaagacgttgttcttcagaggattcttgatctagattcccaagcattttctccccgattacgcgagggggcagatatggcgaacttactgctacgcgaccgcgacgcggagcgcgttggcatcaattgggcctctcgctttgtacagtgaaaatcgcacaattagagaggcaaaatgagatgcttaggccgaaaaaacggactcgattgcttcctaacccgaatagtaagttctcaacagttgaacagctagctaaacaagcagcgcgatacgatacgatcccggatgagatagaggcaccagaggaattagaaaattacatatttgaagagcttttttgatttcccatacaaatgaattttgcggaaaatcaaaagtggcccgggaaccgaccgtggcgtgcacgagggtacatgtgggtcggtctaggatattctcagacgatctaacctatacccaggctaccctataaccagcctaccctagactaggtcttagatcttaaataattccttcagctttaagttagattttggtgtggtcgacagtctgcatttcaagctcgctaacagctgcggtgttgttcgtttatccccaacacaaatggaggtctcagtggggagaacccgggggctatatattgccttcatccattctcaaactttaaatatgtaagaagctcttgttgcttaattgaacgtgatcattcgaaacccgggggctatatattgccttcatccattctcaaactttaaatatgtaagaagctcttgttgcttaattgaacgtgaccattcgaggcagaacacccacttctgtctctctccctgaccacgcgcaactgtggtctcatctgagaagataacccgcttccaccatgataggggctttcgtatatgaagtctcgcgaattggagccttttttctgcaacagcaggtgttaatttcggcctacggaggggctatatattgccttcatccattctcaaactttaaatatgtaagaagctcttgttgcttaattgaacgtgagcattagaatgtatcaatactagtgggccatttttggtaagcagaactggcgatgcgggatgaaccgaacgcgaggttaaggtgctgtatccgtcgagttggtcggcatcgagccacgggatcatagggatatctatattatctaggaatcgttagctaggagctaaaggcagggagagtgagatgaacctagtaatgtggtcgccctcagggtagaaacgatgccctgaggagtaggcggacgtggaggtcagtgacgaagcctagggcgtgagcccgggttgttactaatgcttgtatcatttttgttcaagttaaatacaggccagaacgcagccttcaattactcttcaaatggcaactcgcacggtttacacaatagaacccatccagcgccggcgagagcagagctctccccagaccaggcatcctcagtacgacgtaccgcacgcggccgctctcgtgagggtcgacgcccactatgaatcacccgccagcgaagccgaagccgtctagcctgtccaagtgaccactcagtgcctattctacacctcctatgtcttttcacaatgtcaaactagagtcaagctcaacagggtcttctttccccgctgattctaacctatacccaggctaccctataaccagcctaccctagactaggtcttagatcttggataattccttcagctttaaagataagatataaaaggtgttagtacatccagacagttggacggtggccatggaagtcggaatccgctaaggactgtgtaacaactcacccaccgaacttggatcacagttgcctactcccggttaccaggctggactagcttagcctttgtacgaccctctgaggtagtaaccactattccagggaagatacccaggtgctggctgccgccggccggttgcccggctagtggctgcctgctcccgaggcgtcctcccaaagcccaacgtagctctccgatgcggaatatcactacttcgcagaggaggccacgacgggtccgccactagatttaggggccggccgtccctcgttcaaccctgaataacttcacaactaatagcccaggcgggaagcaaattagataaaaagtatattcagccaaagggcaaaccaatacatcattctcagatgttctggggtgcctttggttggaatattcgtacatctttggtgccgcttcttggagacccggacagccttggggcgcccaagccgcaccggccctagtggtcttggtgtggtggaaggatgccctggggaactgagagggggaagggggattgccgtgcgcggcgtcggtggccctgccgctggtgctgtgttcggcgcgctctcacgagtgccattcagtaactaccgatggcttgacctttctcaccgtggtaagatagtcgtgcatatggacctctgcatgaataaaagtcttggtcttcctgtcgaagatctgtgcctttatcccccggggcgaactgatgctggcctgggcaggcagagtgcaccgcggagaaccacggatgatcaacctgcccaagcgctgtaagtcgaggacagtggctagatacagggagggccggtctactgagcgtgagctacaggcggtgagatagccggtggggtgcaggttatgtgaggtgcaggttatgtaaagtgtaggtcatgtgaggtgcaggttatgtaaagtgtaggttatgtgcgggatgtaaagatagactggctaccctgcagccgcttcccgagagacagaccgggcgccagaactctggcgtcctaggaacaattggagggcaagtctggtgccagcagccgcggtaattccagctccaatagcgtatattaaagttgttgtgggtaaaaagctcgtagttgaaccttgggcctggctggccggtccgcctcaccgcgtgtactggtccggccgggcctttcccatgggtctacgctaacggatattgcaccgggggagatacgaaacaaagtgacacgagctaaaaccggcatgattggcttcttccgagatatccacacaagcgcattagcatggggttcgatcgtccatgccagtggtctatcactgtcgggattgcttaccaaaaatggcccactagtattgatacattcgaatgctcacgttcaattaagcaacaagagcttcttacatatttaatgtcgcaaaggcgacgcgaacgcgtcgatggcgaatggtgggggcaggtggagggtgctgacataatttgggcacccgggtgcgccaggatgtttgggcatccggggagctaccactcagctgactttgagacctactgttaagagcagaagattattacagtctgtatgcctccccactcctcttatcttcttcagctattagatgttggctgctttggactactaaagcagttgtacagaagagaggttgagaagctaatacggatgtatattacctatattagcaagcttgagtttctcgcccagtgctctgaatgtcaaagcgaagccattcgaccaagcgcgggtaaacggcgggagtaactatgactctcttaagctagccaaatgcctcgtcatctaattagtgacgcgcatgaatggattaacgagattcccactgtccctatctactatctagattcgaactcacgacctaaacaacttcaacgttccgctcaacctctgagcttctcgagctttatatatatcactaggaaatctaatttccttatttttattttttttttagtccgaagggtattataaggtacttatagaggctgaactttattctgaatactgttttctatttatctccttctttaatttatcagccctggaagatatcatgagaggccggccgtacgttgttgcgagtgtcctgcccatggacgagagcattagcctcggcaactagcgacgtgggatggtattgcggtcattacctgtccattaacacaagcgcggcccatatccgccatatgatatcggcggctttggcgctcttggtcccggctgtcctctacgtcgccatcccgtggcttctttagccgcgcaaccagccagttcattgccatctatccccttgtgggctgggatccatcggatctctacggcaaggccttgtatttgcagttcttacaaattagagacaatggatggaacggcagtccgcggcacctttgcgcccgaccgtttgaaggagttccaacaagataacgagggttggtggagaagtgacgatgactcccacttggtagagggggagctagaagaaaacgacacagatgctctcgcgagccaccaaattcctgaccaacttgggcctgatgaagagaaacttttggcagacgatgctactggctcgaggctgcggcgagcacgtacccgtgtcttccgatgccggcagttgctgcaagccaatgcgactctgcggctcttgtttgggccaccaccttcacccgcactggcctttgccgatgtcccccagcttgcctgtgggtcaacttgggtcgtcccactgtccctatctactatctagcgaaaccacagccaagggaacgggcttggcagaatcagcggggaaagaagaccatgtagaccggccctccctgtatctagccactgtcctcgacttacagcgcttcccaccctctaaaacaataatttaccgcggctcagaccggccctccctgtatctagccactgtcctcgacttacagcgcttcccaccctctaaaacaataatttaccgcggcccttaacaacttttttgattttacataccctgcagcgcccgcgggacgccctcccatgagcctgggtactcttcagaaatagaccggccctccctgtatctagccactgtcctcgacttacagcgcttcccaccctctaaaacaataatttaccgcggcgcttaacaacttttttgattttacataccctgcagcgcccgcgggacgccctcccatgagcctgggtactcttcagaaatacttttatctgaaagaggctcttaagctgatcagttaagtatagatattagatatcttatctttaaagctgaaggaattatcactttcattacgcgtaggggtttgacacccgaacactcgcatacgaagacgactccttggtccgtgtttcaagacggggcgttgatgaccattacgccagcatccttgcagagcgcgaacctcagtccaccccagggtattacacagtgggctataacggccggaccagtacacgcggtgaggcggaccggccagccaggcccaaggttcaactacgagctttttaaccacaacaacgttaatattccaggcaggctttattggatctggcctaatgccgtacgacccagagagggttctttcaaagctagatataatactacgcacaccaacaccaccagagaccctgcctgagataaggcagccctgggttctaaagacaccacagactgcgtacgaggcaatgtggtttctgcctacccggtaccccaacttcaaaccggtctcccgccttccacgcggatcggagggaagtgagaaggccagctgttgagcttgactctagtttgacattgtgaaaagacataggaggtgtagaataggtgggagcttcggcgccggtgaaataccactcgctaccgccttcattgaaactagctcctcagtgctcgcacatcagcagtgactcgcacagcaccaagacaacctgatgcaagctaagcgtgccacctaccacgacgagaaaatctgccagctaaaccctttacttggccacagcatctttgacgcccagggtattacacagtgggctataacactcccgagggagccacattcccaaagcctttatcccccggggcgaactgatgctggcctcgatcgtgcagtgaaacaagcgtaatgtgggggtttggctggcggggaggatgtctgcgtaagtgagttgtgctcaaacgaaggcgctgtcgtatatctctcctactagtctctgttgggcccgttggaggatttgaaatgacgctcagacaggcatgcccgccagaatactggcgggcgcaatgtgcgttcaaagattcgatgattcactgactgccgttctggcggaaggtacagggtatcatcgggcagcgcggtgatggacccagtgcattcctctgggcggatgaggggatcaagagggcagcaggcgacgcagatggaagcacactgacagcagcaccggagcccgagtcagtgtggtcagcagataaatcaacagtccgattctcaagatcatatgtatgtataaaatagtgccctgaagggtcttaactaaaccttgggtaactttggctgcggttctggagtgggctgtgacatgggggtgcccatttgtaggccaagtccaagaaatggaacaaagaactgtgccggaatattgaccggcttccctttcgccacacggcgcaaagtgcgcctttgaaacggaacttccctatggcttaggctcgactaacccacgtccaaccgctgttcacatggaacctttccccacttcggtccttctgttaatggctgggatgcatgagcatattagcccaatagttaattccataactctaatcaccgtgttagttcttgtatcactcatgcagtcgcagaatcgtaacttacgctgtggaaataagcaaggcaatccaccaagtggcatccgtagcgtagagtacccaggctcatgggagggcgtcccgcgggcgctgcagggtatgtaaaatcaaaaaagttgttaagagccgcgggaaattattgttttagagggtgggaagcgctgtaagtcgaggacagtggctagatacagggagggccggtctactgagcgcctcgcgttcggttcatcccgcatcgccagttctgcttaccaaaaatggcccactagtattgatacattcgaatgctcacgtctgcctagcgccatgccctgacacccgctacatccttgatcagctcagttctgtaagcacttatgcctagtctaaaggaccaaaatccttaacgctaaaagcaggtgcccaaccactgggtaattactgttactgatgggcagatagatttgtgcttggctcgtggttatgatgggcaaactctctgccgggacggtgtgcaagacgccacattgtctttgttggagccaagcgggcgataggaaggcatcgtcaactaccgagataatccacgagcattgaagcccgcagcctataaattatatattaggttatagtaggtctatataagtagatagctattcttaagatatagcttttcttctagctagtctctatcctctgtaagtacctatagtagtactaggtaggctagcgcggtttggtggccgtgagtcgatttttttgatttcccatacaaatgaattttgcggaaaatcaaaagtggcccgggcaccgaccgtataaagggccctctggaggctggctgtgccctggaggcgttagttgtgccttcaggctatagctaattaatgcaggctagtaacacgatgcactgtgtgagcgacagctaaggtgtagcgcagcaaacagtatggtaacacagttgggggcatcagtattcaattgtcagaggtgaaattcttggatttattgaagactaactactgcgaaagcatttgccaagcctgtgatgctgcctggagagcgttgccatattggccgccctgtgcgttgatatctgcgcccttctcaaccagcagctgcacttcttccttcaaagtgctggatacactcatctacagctatattcgtaccagggacccagtatcgaagagaagctgcttgaatagcctcagactattcaaaaatacagtcaaaagagccctcgtaaggttgacgattcaacaagacttcgtgcacagcattcatttatatggtctttttttctcagtaatgaagaattttcagaagttgaaagagctttaaagacatatggtaatatattcattattggccataatcttcaacaactttataaggaagcatttaagaaacctaaatcgacaactatacgaatctcagctcatcaaaatagctctccaacctctatgctggctgcaatggatcaatttacaaagggggcaactgcaataatgcaccaggtggctcttttacgtgctgaggtccgggatcttcgtacggcaaatgaggtactaagcaagcgccgaagaggggctgccttatctcaggcagggtctctggtggtgttggtgttcgcagtgccacatctagctttgaaagaaccctctttaggtcgtacggcattaggccagatccaataaagcctgcctggatattttcctctgtaaagaagtggaagaaagctgtacaaaagaaagagagaaactcaagcttgcgcgcacatctccttctccagtatcttaggcgatatagccttcagggtagcttagaagagatgggatggcgggtttacaaaattattaacaccaacaccgccaggcacccctctggaactgcctacagtttgggaatcaaagacgccaaacaacccaattaaggctacttcacagtctgaatacttgcgaaatagggtaatacggcatcagaacagctctccatctccaattcttgatagaatcaataagattgcaaagggtacacagcgtgttatgcatgagaaccccacagaccccgccttcccgaaagcgccctcgggacgacgcacaaccagggggacttctgactccgccagccacgagacctcaccgccgagaactctgcctggggcccccgccgtcgtctccgcgttcagttgcgttgccgcgcaaaacccacatccaggtgccggagtatgacgctcagacaggcatgcccgccagaatactggcgggcgcaatgtgcgttcaaagattcgatgattcactgaattctgcaattcacattacttgggttgggtggtttctctcttttctgttatgtcggggttgggggcctctctcttttctgttatatcggggttggggggtctctctcttttctagtatatcggggttggggggcctttctcctttctattatatcggggttggggggtatttctcctttccgttatatcggggtgttgttgtggttaaaaagctcgtagttgaaccttgggcctggctggccggtccgcctcaccgcgtgtactggtccggcctggcccagcacatgcacctcactgggaatgccaccaaagcatattcacacacaacacacgccacctaacctatactttacataacctctcgaatcgcatggccttgcgccggcgatggttcattcaaatttcttccctatcaactttcgatgtttgggtattggccaaacatggggttggggggtatttctcctttccgttatatcggggttgggggcctctctcttttctgttatatcggggttgggggggtgggggcctctctcttttctgttatatcggggtgcgcccgccagtattctggcgggcatgcctgtctgagcgtcatttcaaccctcatgcccctagggcgtggtgttggggatcggccaaagcccgcgggattctgacttagaggcgttcagccattatccagcagatggtagcttcgcggcactgcccggtcggacagccgcaaaaccaccaccaatcctgaaaagctaaaccctaagccacttcagaaaatgattttatggcgttttcttgagttctgcttcaagagggttggtgtgtactttaggacactgtccagatccggcctaatgccgtacgacccagagagggttctttcaaagctagatgtggtgctgcgaacgccaacaccaccagagatcctacctgagataaggcagccctgggttctaaagacgccacagactgtgtacgaggcaagcgcacagttgattcactgaattctgcaattcacattacttatcgcatttcgctgcgttcttcatcgatgccagaaccaagagatccgctgttgaggctccacccctggtggtgcccttccgtcaatttctttaagtttcagccttgcgaccatactccccctggagcccaagcactttgcaacagtatacataagcaactggaagtcagccatagcgtgtatcaccccgctaaaattccaaccccagcgcacccaaccctacagcatgcggtctttattgggcgtggtttgtcactttttggaattttcgaccagaaaatggaaaggtactacatagcccacccagacactctcaccatgatcatgcaagcacccggccagttacagggcacctaccctactaaaacaacccacaacaagacccaatgatgtgccatatcgcaaccatatgattgtagctgtgttagtgcccaacgtccaccctcatcggcttcctcgatcgaacgattatagttatgacggctgcctaccgccaacatagtattgagtgttgccgcattgctaaccagacccaatgatgtgccatatcgcaaccatatgattgtagctgtgttagtgcccaacgtccaccctcatcggcttcctccagggtagggaatcaatccacgacttccacggtattgatcaatatgttgacttcaatccacgtcaacgtcaatccaccaagtcctgaggctacccattgccattaagtcgagggtgaaacagcaatcctccgcggtaaacgccacctttgagagccgtttcaatggggtgcatagacgcggtgatagtggctaacactttccaaatggtaggtacacaagtcctgaggctacccattgccattaagtcgagggtgaaacagcaatcctccgcggtaaacgccacctttgagagccctttcaatggggtgcatagacgcggtgatagtggctaacactttccaaatggtaggtacactagtgccagggtgtttgtgataacctaataatagctctgctggtgacccggacccctgagggttcctagggcccgctaagccgtagcggtcatagcggcctgtagccactgacccacagtggctgcagccgctattggctagtgattgttatcgctaagagatagcgatctcaaccgctcaaagagctcgcgaagctgattattctgaccaccacttcaaaaaaagtcatgtatatcggtcgcgcggtttggtggccgtgagagctgaactctaaagctcaggccatcaatagatgtggatgactacaggccattagcggcccctcaaaagtgtaaaaaaacgagctgtttctctccatgaactcgtgatctaccacatccgtcgccagcggtagcgccagcatcttcagttcctctcctccttccacctccaattcctgctctcggatcattccacgccaacccaaatacttcccgagggatggggatgctctcgcgctgcgcttcctcggccacttctttaaccatccgtcgccagcggtagcgccagcatcttcagttcctctcctccttccacctccaattcctgctctcggatcattccgcgccaacccaaatacttcccgagggatggggatgctctcgcgctgcgcttcctcggccacttctttaactgcacgctggtggcttaggatcgactaacccacgtccaaccgctgttcacatggaacctttccccacttcggtccttcaagttctcattgagggtccctaatcattcgctttacctcataaaactgagttcaatactgctatcctgagggaaacttcggcggaaaccagcgactagaaggttcgattagtctttcgcccccatgccgaatattcgctcgggctggaaggggtccggcttgtggcctgttaatgtagctaaacccttgatgagcccgtatgtgatgaagccggtgtttgggcccttccggccaccttcaactcctccctcaacccacaacaactttaatatacgctattggagctggaattaccgcggctgctggcaccagacttgccctccaattgttcctcgttaagggattctgacttagaggcgttcagccattatccagcagatggtagcttcgcggcactgcccggtcggacagccgcaaaactactctactgcttacaggaccgtttcgcacagctaagtcgtctgcaaaggatttgaccccgctcgttttaaaattacactacgcgaaatactacagcacacttctagtaccgtagagtaatcgcctgctaagacgctaagccgaagcctattcttgtcgcctgcgacaacggctgagcatcaccagagttttgcagcggtgctccatactctgcacaacgcagtgcgggattccgatgccacgcgacgtataagggcaagaggccttcctcaagggctttctgatagctccaggagctgtaacctctacgaggggcgttctcatcacgtgtcataggcacaaggggtgtccttccggtcttccagattcctccccaatacatctgcgaaattgaaggctgattgtgatcctgcttagatgggttatggcgcgaatgtgtgccaggccggttcgagatccatacatagtatcgctatgaacccctattatagtaggcatgaggggacatgtgttgatggcgctatgcttgagcagtggatgagcatggtggtcgataataggtgtagttcggatgttggttagtgatcgtaatcgctatcagatagcgatctcaatcgctattggctagcgttagcagggggttattagcgattatagccagtggctgcaatcgctaaaggctagtggttgcgatagctagcagctagtggtcaggatcgctaacagcgatctgagcgcacagcttcaaccatggcggtgtccgctgcacgtggcgatctcccgttgctcagtggtaagtttagccagcggccctccatccacagaacccatccagcgccggcgagagcagagctctccccagaccaggcatcctcagtacgacgtaccgcactccagaatgatatattccttcttttcttaccttcgcattcatcgcacgtattacagccgcttgatatatcagtcttttcgccggtcaagaaatcaaaaaaatcgactcacggccaccaaaccgcgcgaccgatatacatgacttttgtaaacccgccatcccatctctgagcgtctactctggcaccttaacctcgcgttcggttcatcccgcatcgccagttctgcttaccaaaaatggcccactagtgtatttagctttagaagacgtatacctcccatttagagcagcattcccaaactacgcgactcgtcgaaggagtttcacagaggctaggcatccaaccgtacggggctctcaccctctatggcgtcccgttccaggccaatgtgaaacattttggggttatagggtatgccccagagccaaatcctacaccgcagtagcttgctttgttcctcaagttcctttgcgcgaaccgcgacctgtttgcctctcctatcttatcaagcatgcagcgacaattcccagccaatcatcggttgcttagaatactgtgactctctcacaaaaataagattcttttgcgctatattttgcactatattaggtccctctagcactaaaactcactgagtactagcggagttagcagttgagagctataagttatagcgaacttccctgctgcgttatagcggtctcaaggcctaatacacctaggatattctcagacgatctaacctatacccaggctaccctatagccagcctaccctagactaagtcttagatcttaaataattccttcagctttaaagataaggtatctaatatctatactcaactgatcagcttaagagcctctttcagataaactaggatattctcagacgatctaacctatacccaggctaccctatagccagcctaccctagactaagtcttagatcttagataattccttcagctttaatgggagaagaggcaataccgagttaccaatatgccagcccggacgaggtcagtgctttcgccatagaaggagggagcaatcacgatagctttacggcacgcccagaagaaactcatcgaggcctcttcgtattctcgctgtacttctgggcgcgcatcacaccttaacctcgcgttcggttcatcccgcatcgccagttctgcttaccaaaaatggcccactagtattgatacattcgagcgcggtttggtggccgtgagtcgatttttttgatttcccatacaaatgaattttgcggaaaatcaaaagtggcccgggagcgcctgatccggggcacacgaggcgcccggggcaatcccgccgaagcaacagtaggtatgttcacatgggtttgggaggtgtaaactcggtaatgatccctccgctggttcaccaacggagaccttgttacgacttttacttcctctaaatgaccgagcgaggactagaatgaattggctgatatactagattatatatacaactagacaactagtaattattagtctaccttgttcattctaccccggttatcccaacaaagtcaagaaactagacaagatgtcggggtcaccacattacagatatggtggcgaggagcccaacatgatgtttaaagccccttccctcatccggcagattgaagcgggtgacttccaagacctggtcaacttcgaacgcgtggaaggcgggagaccggtttgaagttggggtaccgggtaggcagaaaccacaaccagctaccctatacccggcgcactcaaaccaaatctgccgcataattggtttttgcggctgtccgaccgggcagtgccgcgaagctaccatctgctggataatggctgaacgcctctaaggcagaatccatgccagaaagcggtgataccacccgcacgtacagatggacaagaataggcttcggcttagcgtcttagcaatcagggattatttgctctgtccagccaatcatacccctgtaagttacatactgctcccttagctgcaccaaggagatagcttactagcacacttatgcctatttcgcacatgtcggcgtgggttattttcagatcaacttatgcgaaaggagccaaatcgactgctcgctgatcgcgacgcgcctcttgtgggaccacgatgggcttcaaactttgtcaaacgccaaaaagagctctgtacacgttttacgcgtagatataaatcgactgctcgctgatcgcgacgcgcctcttgtgggaccacgatgggcttcaaactttgtcaaacgccaaaaagagttctgtacacgttttacgcgtagatatgactatcaaagagcattatgtgaggatccaaagctaattcagccctggtttgatctgaagttaagcttatagctttctttttagaaaaattagaaggaactaagatagaagggttatttactaagagatcttgagatccacaggcctcgtcagaacaagtgtgctgtagtatttcgcgtattgtaattttaaaacgagcggggtcaaatcctttgcagacgacttagctgtgcgacacggtcctgtaagcagtagagtagccttgttgttacgatctgctgagggtaagccgtccttcgcctcgatttccccaatcccgaagttgatcaccgatatcaacaccacccatattgtcattgtaatccgctgaaactgacgggatctgaaggaatttgaccggctttccgctaaattccctcttgatcgggcgtgcccttgttattattattattattattattattattattattattattattattattattattattattattattattattattattatcagacaccacaaaaggtgttagtacatccagacagttggacggtggccatggaagtcggaatccgctaaggactgtgtaacagtttgggggggagataaaccgcaggcaagcctacgatggctggatgaattatctccagtatcgatggttacttcccttaattggaatggaatatattctgttaaaccataacgcaggtgtcctaaggggggctcatggagaacagaaatctccagtagaacaaaagggtaaaagtccccctgttaaaccataacgcaggtgtcctaaggggggctcatggagaacagaaatctccagtagaacaaaagggtaaaagtcaccttgattttgattttcagtgtgaatacaaaccatgaaagtgtggcctatcgatcctttagtccttcgacgtgtgaagcctgttaaaccataacgcaggtgtcctaaggggggctcatggagaacagaaatctccagtagaacaaaagggtaaaagtctccttgattttgattttcagtgtgaatacaaaccatgaaagtgtggcctatcgatcctttagtccttcgacgtgtgaagcatagtaagctattaaaagcttatattttatatctatttatactataagtaattattaaaacttagagataaatattattcctctatccagcgctgcccacaaatcaaatgcaatcaaacaaacagccaaacaaatcaatcaaatatgccagaatcttatcccaaatcaaacaaatgtccctgttggtttcttttcctccgcttattgatatgcttaagttcagcgggtattcctacctgatctgaggtcaacctttgaaagttgtcagtcttctctatctactttaaccgcaaactaccaccaccagttagatcgcatctagcggaaaacccacgtctacttcagtggagtcgagaaaactctctatcccgcagagctgggaaatgccgaaacttcacgaaatgttactattgcacctgctggcgctatgggcgcggggtctgtggggttgccgatgacatcggggcttgaggagggtgggcaagccgctcggcggaacctggtgtttgcctctgaggcgccacttctgcagtactaaaggaatattattataattctctataaatatattattaaaaattaaatctatctttatactcttactagctataagatagagtaataattctaatagatataattactagatctatatataaaagagtagttttattattataaataaatctataataaagtatagatttaaataattaatatctaaaaagagatcctaatagttattattaataactattattatatatataagaatctaattacttataataataaagctctagttatagagaataattatattaaagatatttattattattattataagagatagttagtaataaattataaaaagagataattagtaataaattataaaaagagatagttagtaataataagcttaaagagatattataattaattatagataataagtatctccctttaggatctatagctaaattatatatttaataagcttttcttagagtttttagagttattattatttatactttagctagctatataataaaaagtaaaaaaaaatagaattaaaagttagatatagattagaatttagttaaaaactaattatatagattatattatatatagcctgatcttagaatattatctcttatatatagtaaaaacccctaaaaaaaataaaaaaatacaaaatataaacttttaataatttactatctataaaataataattaaatagaatatttaaactaaactctaaaataatatctataagtatatattaattattaatatataattccaaacttaattttaaaaataatatatagtaatttttataattaattaatacttttcttttaaagattctataataataattaattaatctattataattctaaatattattaaattaattttatttaatttaatttttctatctaataaactttctaatatgtcacgggctccacctacccccccacttttgctgaagtgacttgaaggttcaaaggaacgcgttacagcctaatccacatacaatttcatttggtgtgaccgtggcgtgcaagagggtaaatgtgggccggtgtatttctgaagagtacccaggctcatgggagggcgtcccgcggggcggctgcagggtagccagtctatctttacatcccgcacatctccttctccagtatcttaggcgatatagccttcagggaagctatacatttgcgaatgtggtatgcagaagggttagagtagcagtgggcgtgttacaccagctactggaggttcggaaagcgcaaatcatcatctcctgctatgaccgggataaaatgaccgggacaaattggaaacaatgagattgtagggcttgaatattccgtatcaaagacgtgcctgcagaagctatcgacttcagcaactgggaaaaagctgaacaagctgtcgtcaacgcctacgaaatcgtcgatcccgccgtttacccgcgcttggtcgaatggcttcgctttgacattcagagcactgggcagaaatcacattgcgtcaacaccaccgcagataccgctcgagctcgctacccatcgccggagccttcgctgtcctgcttttgacccactgcttaaacacactcccttttgatattttcggtggtacgcttgggggtgccgcagtctccacaattgccttttgctgctcatccaccggcccgtcaggggagatatatcgtctcaggaagccaaatgacatccatggttgaaatcacgagaattttcaaaggtgttcatgcctttccctactgtctcccaacatggaatataccaaattggattctagagtttgtttgtccgccaatgggactttctcggcatagagtgatcgaaagatgaaaagcactttgaaaagagggttaaaaagtacgtgaaattgttgaaagggaagcgttcatgaacctcattatcctctcaccctgcccgaggctgcgtggcggcggcagatttggtttgagttcgccgggtatagggtagctggttgtttccgcccaacaaactcgagaccgatccaccacacttgggagttgatggataataaaaccaccttccgttttccgtcatacgccctaggcatcttcctatcacaccttgttgctgcgcacataatcctaagattatcccaattcaaattacacggtttaactgcaatagttgcttgtcttgggtgcgctgcatggagtgcagatgttctcgtatggaagtacttgaaatgcaaggggcatgctcgttgatatttctcgggcggtgcttgctcctggcaccgtagacatcatcagcggtcagacacgtcgcaagcgcgtcttttgcatcgatggtgtgcaagggtgtaggctagctcaggggctcgtcgctctccgatgcggaatatcactacttcgcagaggaggccacgacgggtccgccactagatttaggggccggccgatagctctgaaaagaaaaacatccgcgcctgtggctttctgtgttttaaacatatcgtgtgcttcaaatataattcggttctggacgtctgtcggcactttcagtcgtccttcagcaactacatcttcaaaatcctgaacaacacacttcagttttggaatagctctgaaaagaaaaacatccgcgcctgtggctttctgtgttttaaacatatcgtgtgcttcaaatataattcggtcctggacgtctgtcggcactttcagtcgtccttcagcaactacatcttcaaaatcctgaacaacccagagccagccactcgatggccaccccaaccacaggccgagagaatcaacattgccaccggaaatcgaccgactttagacccaccgcgacaatcaagggctggacggagcaagtcgccggccaagagagcccagaagagagtcaactttggtgacgacccagagccagccactcgatggccaccccaaccacaggccgagagaatcaacattgccaccggaaatcgaccgactttggacccaccgcgacaatcaagggctggacggagcaagtcgccggccaagagagagtagcgccagagaattactcacaggttctaaaggtaacgtgggtgcatagcgagctggacagcatagcgagctggacatccaaaccgaccttctcgcaaagaggttgcaaaaaagcaaccacaataaaggaaatcgatcagttttaaatgctattctcagtagcgccagagaattactcacaggttctaaaggtaacgtgggtgcatagcgagctggacagcatagcgagctggacacccaaaccgaccttctcgcaaagaggttgcaaaaggtcctcgtgtccgctgtagcgcttgcattagcggacctcgtgtccgctgtagcgcttgcattagcggacctcgtgtccactgtagcgcttgcattagcggacctcgtgtccgctacattgtcaggtggggagtttggctggggcggcacatctgttaaaccataacgcaggtgtcctaaggggggctcatggagaaacattgtcaggtggggagtttggctggggcggcacatctgttaaaccataacgcaggtgtcctaaggggggctcatggataatgtacaggaatcacaggatatagtagcccaacaggaggttaatagtcagattacccaggaagagcacttgggtcgggggcggaagccacgggataagacccgtgttcgacgatgtggtatatgtggtaagacaggacataatgcacggacttgtcagaggaatcttctgagtagtttttacaaataaataaaaactttcaacaacggatctcttggttctggcatcgatgaagaacgcttgagtataggttatgtaaagtataggttaggtggcgtgtgttgtgtgtgaatatgctttggtggcattcccagtgaggtgattggctcacaacagctcgaatacacacataatagggaatgctttcagacgttcttatgcaaggctgtcccaataaggataccggccctcaggtcgaagggttctctatattgagatgaggaaagggcctaccacgatattataacaacagaatgggttcaaattattatcaacacatattttgcctttaacttagtagtattgcaggtcctatttactccgtatatttaagagagctcttcgatagctattcctttgtaagatcaacgagctcaatgactttaactctcggatacatccgtcgcggctcaatcactgggagctttgtcaccttaattattgctcttcaacgaggaatccctagtaagcgcaagtcatcagcttgcgttgattacgtccctgccctttgtacacaattattgctcttcaacgaggaatccctagtaagcgcaagtcatcagcttgcgttgattacgtccctgccctttgtacaccccgcccgtcgctactaccgattgaatggctcagtgaggcgtccggactggcccagagaggagggaaaccaccactcaggcggtagtagcgacgggcggtgtgtacaaagggcagggacgtaatcaacgcaagctgatgacttgcgcttactagggattactcgttgaagagcaataattgcaatgctctatccccagcacgacggagtttaacaagattacccaggcctttcggccaacgggggcaacgacgatgctgtctgccaccttgtccattgcgtgggttcgtgtcgcgttgcgctacgcgctacttcccaccccgccggtcgccgatgcgcctgcaaacgcgcctactgagattgtaaagattgtaaagattgtaaagattgtaaagattgcataacctgcaccccacaggctatctcaccgcctgtagctcacgctcagtagaccggccctccctgtatctagccactggcctcgacttacagcgcttcccacagagccgtttcaatggggtgcatagacgcggtgatagtggctaacactttccaaatggtaggtacactagtgccagggtgtttgtggcgccagctcgaatctcgacttggagcagggcgatatcgttaacgtaaaatgcacctgctctcgcattgacaacagatacgattatctgttttagctagtgggatcccactagaggccgttcaacccgggctcacgccctaggcttcgtcactgacctccacgtccgcctactcctcagggcatcgtttctgttggtttctaggaccgccgtaatgattaatagggacagtcgggggcatcagtattcaattgtcagaggtgaaattctttgatttattgaagagaaacgccgccccgatcttgcagtatgcctgctccattgggacgtttgacgctgtccaacagctcttggacaacaccaacatgagtaccaacttcgtaatgattaatagggacagtcgggggcatcagtattcaattgtcagaggtgaaattcttggatttattgaagactaaatactgcgaaagcatttgccaaggatgttttcattaatcaggaacgaaagttaggggatcgaagacgatcagataccgtccctcgggcagggtgagaggataatgagaggatgcattggatcgagcaatgtcttttgcgtgatttggtacagcatgcgggctttattgggcgtggtttgtcactttttggaattttcgaccagaaaatggaaaggtactacatagcacacccagacactatatgaatatccctagttattacgagccagaaggatatcggaatgaccttacgagccctagaccgggctgcttgcttgaaaatacgatcgagggattctcagggatataagggccgcggatcccttctgtaattactagttagaagcaacagtctcaattattagttaatttatctctataagtataatatatatttactactataaaaggtttttattaggaataatatagatttaatattaatctaatatctttactagggcaatccctgttggtttcttttcctccgcttattgatatgcttaagttcagcgggtattcctacctgatcttaggtcaaccttggaaagttgggggtttaacggcaggggctcgtcgctctccgatgcggaatatcactacttcgcagaggtctttgcagcttacgcctctgacggcagctcaagaaagctgtttaaaactggggacgaaaataagcctgtatcacagcacaatcatgtcaataggaagaaaagaggtcgctgcttagcctgtcagggctttcagcttggccaaacccggcttaaagagccctagtaacggcgagtgaagcggcaacagctcaaatttgaaatctggcgcaagcccgagttgtaatttgtagaggatgtgtctggggtgtgccaaattcagcattgcctaaaccactaggtcttctcaaatccaatgctagatttcatctggtatatttgctagggtgtaacacaattcgggtttctggacctcaaagcgtgacctgatcgtgcttgagccaggcggtgtcggaaggcgatgagaagagtcacagtggacagaggcctacatgaagccggacaaggaaaatccgatcgaagtgggtggaataagaggcaggcaaccttgatcctttatatcttcgcagatgggatccaacggttgaaaccgaaggtcgcatcggagagcgacgagcccctgccgttaaacccccaactttccaaggttgacctcagatcaggtaggaatacccgcggaatctaataagaatctagaggctttagaggaagaagtagaagatataagaaatcttctaaattcccaaactgaagagtttagaaccctaaaaggctctataagtaaccttcacttagctcttcaaaaccttactcaggttatctcttctaattctaatagagaagaaaagattaaaagagaagaaatagctagtaaaatcgacgagcccctgccgttaaacccccaactttccaaggttgacctcagatcaggtaggaatacccgctgaacttaagcagatcaataagcggaggaaaagaaaccaacagggattgccctagtaacggcgagtgaagcggcaacagctcaaatttgaaaatttctctcataggtctaccgactaaaaactactctaaaacccgctaaagctgcttcctgggctacttttgattttccgcaaaattcaatccagctgccgacgtcttctgctagacgaggtgatggatgggtcagggccagggccatgcgaggcaggtgaggcagcgtgtgatgtatgtgccagggctaggcaggcaacaatccagctgccgacgtcttctgctagacgaggtgatggatgggtcagggccagggccatgcgaggcaggtgaggcagcgggtgatgtatgtgccagggctaggcaggcaacagggttagggcgagatgatggagaggaaggggggataataagcacacgttgatagaacaatgtagataagggaagtcggcaaaatagatccgtaacttcgggataaggattggctctaagggttggggacgttgggctttgggaggacgcctcgggagcaggcagccactagccgggcaaccggccggcggcagccagcacctgggtcgagagcgcaccagacccagcagaggtgctgggctcttccggccattaaaccctagctccggacaaaccgatttcagggtggagaatcgacttccacagatatgcaaggggcccgtccccaagataaggatcacaacccctgcatttgaccgaagagtacggaggagcatttcaaaagtctttgctcgcgctaaaaatgccacgtagccacaaaagggatagcttatatacaagatggattacaaggacgccagagtgctggcgcccggtctgtctctcgggaagcggctgcagggtagccagtctatctttacatcccgcacatctccttctccaggagaggttatttcgtagcttaaagttagtccaccatccattagaaaatgtaaaaatagctgcacaattggggtatttcaacgggaaaagcttcctggagcaaccattgcccggaccggaaggaagagatgaatagaatcaaagcggcatatctcacaaggccaaggcttcatccggagccaacaggcacagccactcgatggccaccccaaccacaggccgagagaatcaatattgccaccggaaatcgaaccgttcgaccgatatatatagcttttttaagacctacttttatctgaaagaggctcttaagctgatcagttgagtatagatattatttgattttccgcaaaattcatttgtatgggaaatcaaaaaaatcgactcacggccaccaaaccgcgcgaccgatatacacagaggtggaaagccaatgacggtccagactttgcgtcttgcgttgagtgtgtgatggttataacagactgcgaacccaagctcggtccgaatgtgactctgagcgagattgacgaggtcctcgatcagatcgctgcctcatcaccattctcatccgtgcgtccaaccgctgttcacatggaacctttccccacttcggtccttcaagttctcattgaagtatttgctactaccaccaagtcgcgctctgcaaggatgctggcgtaatggtcatcaacgacccgtcttgaaacacggaccaaggagtcgtcttcgtatgcggcctttcggccaagggagtactcgctggctccgtcagtgtagcgcgcgtgcggcccagaacatctaagggcatcacagccctgttattgcctcaaacttccatcggcttgagccgatagtccctctaagaagccagcgtactgccaaagcaatacgggtttctaataattctattctatttaattcttttctatttaataatactaattaaaataaatatttatttaatttaaaaagctattttaatctcattgaagtatttgctactaccaccaagatctgcactagaggccgttcaacccgggctcacgccctaggcttcgtcactctcaccatgatcatgcaagcacccggccagttacagggcacctaccctactaaaacaacccacaacagtatacataagccactggaagtcagccatagcgtgtatcaccccgctaaaattccaaccccagcgcacccaacccactacataatcaaccacgatttacgtccaacttctggttttaaggtccttcgcgggccgacccgggttgaagacattgtcaggtggggagtttggcgggggcggcacatctgttaaaccataacgcaggtgtcctaaggggggctcatggagaacagaaatctccagtagaacaaaccccacttcggtccttcaagttctcattgaagtatttgctactaccaccaagatctgcactagaggccgttcaacccggtctcacgccctaggcttcgtcactgacctccacgtccgcctactcctcagggcatcgtttctaccctgagggcgaggtatcaactagaaaggcaaaggtagcgaactcctagccttatgccacgtaaaacccggacaaatcaaccccatccatactcccaatatataagtccatcgcgtacttcttgtcatattcctcaacggggaacttcaaatcgatcgtcaaatatgggcatgggggcgaaagactaatcgaaccttctagtagctggtttccgccgaagtttcccgcaggatagcagtattgaactcagttttatgaggtaaagcgaatgattagggacccgggggctatatattgccttcatcctaggtctgttgtatcgtagccgcggctatcgtgtgattgaaccttactcttgccttcgaagccgggccggcttccacggaattcctgatggtgtggtcatcccaggtagatagagatgcctaaccccggtacgggtaacacatacctacgaatctctgctcctaaaaatttcggtgaaataccccaattgtgcagctatttttacattttctaatggatggtggactaactttaagctacgaaataacctctcaagaagacgggtcacaagaagggctacgaagaccccagaagaggcagttcaagcccgagttgtaatttgtagaggatgtttctggcgacgtgccttccgagttccctggaacgggacgccatagagggggagagccccgtacggttggatgcctagcctctgtgaaactccttcgacgagtcgagtagtttgggaatgctgctctaaacacaaccagaggcttcgtatgacctatctgtagcggcacagacccaacagaacccgtcagaagaggatatcaacaagttaaacaagagactcacgtggcaaatggaacaccatgaccgcggcctcaacttcataccgctcaatctgcacaacttgaagcggtgagttgttacacagtccttagcggattccgacttccatggccaccgtccaactgtctggatgtactaacaccttttttggtgtctcccgagactgccaccaaccaggtgacaaacacgatgacgaaagacaggtgaggagagtcacagttctctgcctcaagaggcagtgtacactttgagtaagagcatacggggccggacccgaaagaaggtgaactatgcctgtatagggtgaagccagaggaaactctgggggaggctcgcagcggttctgacgtgcaaatcgatcgtcaaatatgggcatgggggcgaaagactaatcgaaccttctagcgtaatgattaatagggacagtcgggggcatcagtattcaattgtcagaggtgaaattcttggatttattgaagactaagtactaccacgctctagtagctacagacgagctcgttcaacgcctcaagtatctgttttacaccttcggatactctgaccaagccctccttcgtaatctccaaagagaaggctttgttgtacatccttttcttatccggaaagttcgcttccaagagcgcctgacgcgtcggctcgagacaaaggaagagcagctagtcagcgttgttgaaagtttttatttatttgtaaaaactactcagaagattccaaaataaaacaagaattaagtttcctaggcgtgcccgctaaaattccaaccccagcgcacccaacccactacataatcaaccacagcgcacccacaccaccacaaatccaaccacatcgggaacgcacgagcgaggcgcctctcataattaagggacaggaggtccggccgaagcgggccgtcaagatcttgggggtgacgatggacgcggagctgtatatagtttatttagtactattatagatatttatagagaatagaaactaattagaagaaaaactatattttaaaaataactatctatttatatagatttattataatctaatatataatttatagttttaatatattatatactatattaaattaattagaattctactttagttattagttctttagattttaatagtttaataatataattaaagaatattaattactatagttattctagtattaaaactagtttaagttctttatatagtttatattatatagattagtttatggttaagactacgacggtatctgatcgtcttcgatcccctaactttcgttcctgattaatgaaaacatcctttgcaaatgctttcgcagtagttagtcttcaataaatccaagaatttcacctctgacaattgaatactgatgcccccgactcttttcctccgcttattgatatgcttaagttcagcgggtattcctacctgatctgaggtcaaccttggaaagttggggggttaacggcaggggctcgtcgctctccgatgcggaatatcactacttcgcagaggaggccacgacgggtccgccactagagagtcgcaagccagcttccacagagccgtattcagccggagacaggaacaaggcgtgagccctctggttttgagagagtcgaaggcaccaggagagccccgcgagggacggccggcccctaaatctagtggcggacccgtcgtggcctcctctgcgaagtagtgatattccgcatcggcgagcgacgagcccctgccgttaaacccccaactttccaaggttgacctcagatcaggtaggaatacccgctgaacttaatgtaaacccgccatcccatctcttctaagctaccctgaaggctatatcgcctaagatactggagaaggagatgtgcgggctgtaaagatagactggcactcgttcggcaccttacgagaaatcaaagtgcttgggctccagggggagtatggtcgcaaggctgaaacttaaagaaagtgacggaagggcaccaccaggggtggagcctgcggcttaatttgactcaacacggggaaactcaccaggtccagacacagcgaacctggtttagttgagagtgcagagaatggatgccacggacgtgctagtgtttgggtgtttaaaatcgaattccgttcttatggcttcactttaggcgttgctatggcgtcttagatggaaaagaatagacagagatcctaatgcttttatcgagttgaacgcacattgcgcccgccagtattctggcgggcatgcctgtctgagcgtcatttcaaccctcatgcccctagggcgttgaacgcacattgcgcccgccagtattctggcgggcatgcctgtctgagcgtcatttcaaccctcatgcccctagggctgccctttgtacacaccgcccgtcgctactaccgattgaatggctcagtgaggcgtccggactggcccagagaggagggaaaccgccctttgtacacaccgcccgtcgctactaccgattgaatggctcagtgaggcgtccggactggcccagagaggagggacagctgaagcattcatcgctgccagccaccggtccgtcaaaatgactgaaggaagatcatgctggtaaagggatttgagatgttgcaaggcccacgagtagtcctcctctgtctcaccggagagaaacgcgaaggcgatacagaaagagcgttggcaggagtcaacgccgacaatacttcaatgagaacttgaaggaccgaagtggggaaaggttccatgtgaacagcggttggacgtgggttagtcgatcataagccatagggaagttccgtttcaaaggcgcactttgcgccgtgtggcgaaagggaagccggtcaatattccggcaccggccaccttcaactcctccctcaactcctccaaaggccgggataaagcgtaaagatcatcacaaaccggatatttcaacgcccaagggcagtcaccaggtccggaagatcattcgcgattttatcgatctcacccatacctcgccctcagggtagaaacgatgccctgaggagtaggcggacgtggaggtcagtgacgaagcctagggcgcctataaggttaggcgaacaaccttaacacagcgacgcgctggtcgtacggcaagacgcgatactcgagctaattcaataaatcttataaaatctgaagaggaggctattgtcttatacgtaattgagctatctacacgtgcatttccccctaggatacgtggtgttgaggaaatggccaatatcctgctacgctgggttgggtgcgctggggttggaattttagcggggtgatacacgctatggctgacttccagttgcttatgtatactgtggtgggttgttttagtagggtaggtgccctgtaactggccgggtgcttgcatgatcatggtgagagtgtctgggtgtgctccctgagggcgaggtatgggtgagacgcttgagcgccatccattttcagggctagtacattcggttggtgagttgttacccagtccttagcggattccgacttccatggccaccgtccaactgtctggatgtactaacaccttttgtggtgtctgatgatttgcggaaaatcaaaagtggcccgggaaccgaccgtggcgtgcacgagggtaaatgtgggtcggtgcacctatgagagcggggcgcgagtgctgaaggcgaaagcctaaggcgctgcagcaaaccactcacagcgtctcgggtcaactgtaacaagctaaacccttgcaaggtacgaaaactgccttgaaggatcgtgccaagtggccatgaatgcacgtttatgccacaccacatgcactgttggacagccagcggtatgcccgggtcggtcgatcctccttttcaataacaaccccccaagacagttgccagatttctatctcaccagatgcttaaatacggactcgttcctgaaactaacaacctaactacctcgattttgcttttcatttacattacttccctgtttacttgccaccccaagacctcggtatcctgctcagaagttatcaagagggctcgaccccggagaaggagcctgagaaacggctactacatccaaggaaggcagcaggcgcgcaaattacccaatcccagggctcgaccccggagaaggagcctgagaaacggctactacatccaaggaaggcagcaggcgcgcaaattacccaatcacgactcggggaggtagtgacaataaatactgatacagggttcttttggatcttgtaattggaatgagtacaatttaaatgcggaatatcactacttcgcagaggaggccacgacgggtccgccactagatttaggggccggccgtccctcgcgggcttgggccgatccccaacaccacgccctataagggccaatatcatcttgcatcttggactcacgacaactatttaccactcgactggcggattgcagtcagtaaaaatggatggactacaaatgagattggtctagattggattaaacacttgataacttctgagcaggataccgaggtcttggggtggcaagtaaacagggaagtaatgtaaatgaaaagcaaaatcaaggtagttaggttgttagtttcaggccctaggggcatgagggttgaaatgacgctcagacaggcatgcccgccagaatactggcgggcgcaatgtgcgttcaacgattcgatgattcactgaattctgcaattcacattacttatcgcatttcgctgcgttcttcatcgatgccagaaccaagctctcctacgttcactttcattacgcgtaggggtttgacacccgaacactcgcatacgaagacgactccttggtccgtggttcaagacgggtcgttgatgaccattacgccagcatccttgcagagcgcgaacctcagtccaccccagggtattacacactgtaaattccaccccagcgtgcatgcaccaccacaaatccaaccacagcacatgcacatcgccgggaaccaaacttcagcacatgcacctcaccgacgcccactatgaatcacccgccagcgaagccgaagccgtctagcctgtccaagtgaccactcagtgggaatctgcaagcgacgcccactatgaatcacccgccagcgaagccgaagccgtctagcctgtccaagtgaccactcagtgggaatctgcacgatacggtacagttgaagagatttcccacagcggatcggacctacgaatgctagagagcctcgaaaaatacttacaattgtccgaggactagaatgaattggctgatatactagattatatatacaactagacaactagtaattattagtctaccttgttccgcccggcagctatgtgtgtggagggggcgcgcagaaattagtcagcagggcgcgccgggtctaaaagcgcgcccgggcacctctgtagggggcgccaatagaagctcctaacttatttaatatttatgcgtgctccacttctatgctaaatacccgataaacttaccactgagcaacgggagatcgccacgtgcagcggacaccgccatggttgaagctgtgcgctgagcactcctcgtggggcgcccaagccgcaccggccctagtggtcttggtgtggtggaaggatgccctggggaactgagagggggaaggtgtcccctaactttcgttcctgattaatgaaaacatccttggcaaatgctttcgcagtagttagtcttcaataaatccaagcatttcacctctgacaattgaatactgatgcccccgactgtccctattaatcattacggcggtcctagaaaccaacaaaagccattaaaccctagctccggacaaaccgatttcagggtgatagaccgttaagaagaaaagagaactctgcctggggccgccgccgttaacctttggatcttcgcatttagccctctgatagtcatatttccgaacccagcgcgtacgaagctctggttgccgcttgataaagttggaagcccaattgacgggcttatctagcccagataagggtctagaaaatccgggaaaaatcctaggatattctcagacaacctaacctataccaggctaccctataaccagcctaccctagactaggtcttagatcttagataattccttcagctttaaagataagatatgccagtggctaagatcgctagcagttagtggttatgaccgctagtagcagccaaaaccccactaatttatagaggctattgttgaatttgagagattatagccactacaagttagtgggttcagattgctgttagcgatcacaaccactagcctctgattcgccaccctcatcagaaactggcggctctggttccgaacagcaggtctttgggcgccttggtcggcagatactgacgtgtcccgccccggcggggtatcctcgtgaagctgccggaggacgtcggccgcgtgggcaattcgtctccacatgggcgtgaagtttggttcccggcgatgtgcatgtgctgtggttggatttgtggtggtgcatgcacgctgtggtggaatttacaggggttcggaagggatgtatttattagattaaaaaccaatgcccttcggggctctctggtgattcatgataacttctcgaatctcatggccttgcgctgaaacggaacttccctatggcttaggatcgactaacccacgtccaaccgctgttcacatggaacctttccccacttcggtcacctctgacaattgaatactgatgcccccgactgtccctattaatcattacggcggtcctagaaaccaacaaaatagacccacacgtcctattttattattccatgctaatgtattcgagcaaaggcctgcctggagcactctaattttttcaaagtaccgcttgataaagttggaagcccaattgactccaacagggggcgcgccgcgtacgcgtagcaggatattggccatttcctcaacaccacgtatcctagggggaaatgcacgtgtagatagctcaattacgtaatgtagataagggaagtcggcaaaatagatccgtaacttcgggataaggattggctctaagggttgggtacgttgggctgtgggaggacgcctcgggagcaggcagccactagccgggcaaccggccggcggcagccagcacctgggtgctgatgccctgctccttctccccttggcgggcgcggttctcaatcgggcgtcaggccagggggctatcacaatgagcctccaccacctaatcatgtgttggatgatactctcccatgagggttgaaatgacgctcagacaggcatgcccgccagaatactggcgggcgcaatgtgcgttcaaagattcgatgagtcactgaattctgcaattcacattacttatcgcatttcggagcgtctactctggcaccttaacctcgcgttcggttcatcccgcatcgccagttctgcttaccaaaaatggcccactactattgatacattcgaatgctcacgttcaattaagcaacaagagcttcttacatatttaaagtttgagaatggatgaagggcgtgtatcaccccgctaaaattccaaccccagcgcacccaacccactacataatcaaccacagcgcacccacaccaccccaaatccaaccacagcgaatgcacgccactgtaaattccaccacagcgtgcatgcaccaccacaaatccaaccacagcaagagggtggggaagggagcatgacgttgttagattccatcggactaagcgtcgattaggaaggaatggcacgcgtcgggagaagtaaacagactggctttgacgcggtttaatattgtgggcttggctgatttttgtgtggtcattaagcgtagcgttcgattagtctttcgcccccatgcccatatttgacgatcgatttgcacgtcagaaccgctgcgagcctccaccagagtttcctctattatataaagtcatgtaaatctaaccagtctgaaaattctcatgcatcaaagaattcttgttttctatctcctttcgtgactagtcacgtctccttttgctatctctcatcatttgctttacccttatttgttctttcctgtcttgtcctattttctagaggctggatctgccgctatccatagtttaaacctcttaaatagttacctcggagttatctgatattaccggcaatgaaaaggcagggtttatttgcaaagacagggtgtatttcgggggtcaccaggagcgcaaggcccgcagggttggtaatctcaccgcctgtagctcacgctcagtagaccggccctccctgtatctagccactgtcctcgacttacagcgcttcccacacttgccgtcagacagtcggcatcatcctgcgctaacgctaagagtatagccagaatacctatagcatccgtcgccagcggtagccggtccttcaagttctcattgaagtatttgctactaccaccaagatctgcactagaggccgttcaacccgggctcacgcccttaatttatctctataagtataatatatatttactactatagaaggtttttattaggaataatatagatttaatattaacttaatacctatttatatatagtcgccacccccgttcctcccaggcccagatgcggcctcgaacaagcagagcatgcgacctccagcgcccatcatcgactggcatgttcatctattcccttgcgccagtgatgatgtctctgccgaccgacctcatccaacccacgtaagcacgtgccggctgtcttcgacgaatatataaggcattttgtgttcaactacgtcgagttagatagagcgaatacaaaggacttgcaaactgactagcatggagggcctcggaatcggtctttccgcctcgaccttgtttggcgggatctgccgcagaaggtcccgcgcgtatgctgccgccatcatggcaccttaacgaggaacaattggagggcaagtctggtgccagcagccgcggtaattccagctccaatagcgtatattaaagtggttgtggttaaaaagctcgtagttgaaccttgggcctggctggccggtccgcctcaccgtctatcccttctaatcgacggtctgtagattgaaggtacctctaatactattcaatggagtgcgaaaacgctaagaaagaccgtaactgtcccccgcccccggggttatatatatcgcgcggtttggtggccgtgagtcgatttttttgatttcccatacaaatgaattttgcggaaaatcaaaagtggcccggggcgcggcgtcggtggccctgccgctggtgctgtgttcggcgcgctctcacgagtgccattcagtaactaattctccagtgcccccaacccgggctcacgccctaggcttcgtcactgacctccacgtccgcctactcctcagggcatcgtttctaccctgaggccgaggtatgggtgagacgcttgagcctgagccatgatagggctgatctctgcggttgtgttgtgactggagttgactgctgacataattcgcgcgtccgggcgcgcgggttctaaaggtgtgctatgtagtacctttccattttctggtcgaaaattccaaaaagtgacaaaccacgcccaataaagaccgcatgcagagcgtcttcaccgatcccgacatggctgctgactttgtcaagaagacgggcgtccacttcctggccccaagctttggcaatgtccacggaccttatcctgccggcggtgcagagaagcactggaggctggacagattggagaagattcacgcagctctgggcgatgcgacgccgctggtccttctgatcaagctagaaaggaattacctaggaaatcccctactaacagcttcttaggtcaatcaaatcgcttggaaggataatgcgcttgtgctgctgctatccacagtctataagggcacagagtttagaataggcttcggcttagcgtcttagcaggcgattactctacggtactagaagtgtgctgtagtatttcgcgtattgtacttttaaaacgagcggggtcaaatcctttgcagacgacttagctgtgcgaaacggtcctgtaagcagtagagtagccttgctctcatcatttgctttacccttatttgttctttcctgtcttgtcctattttcccccgtcttcctttgctttatctctttattcttccggttcttatacttttcatccaagtatcattgcgaggtggtcaagatggttcgtctcagtgccgtctcttcgcgctctgcaaggatgctggcgtaatggtcatcaacgacccgtcttgaaacacggaccaaggagtcgtcttcgtatgctagtgttcagtatgtgatacgatactgcagtctgccgtatgcaatcccgacagtgatagaccactggcatggacgatcgaaccccgtgctaatgcgcttgtgtggatatctccgatttttttgatttcccatacaaatgaattttgcggaaaatcaaaagtggcccgggaaccgaccgtggcgtgcacgagggggaagcaagtcgtggagatatacacttgcacccatctaaccaagtcaaaggacaagttagttgcaatttccgcacttgccaaagaagcgcgtcacggtgtgcaagacgccacattgtcttatccaatgcctcctttgcaagcactgagaattggcaacctgtacgtcgtgttatagtcatccgacgccgtgtatttgaggagtttggtggcgctcctccacggtcacagctgaagaaaacaattcgtctcccactctctgttttcttcgacgaacttccctatggcttaggatcgactaacccacgtccaaccgctgttcacatggaacctttccccacttcggtccttccagttctcattgaagtatttgctactaccaccaagatctgcactagaggccgttcaacccgggctcacgccctaggcttcaattcttactcaccctaacccatcaaaaccctgatgcggattattcaataggaaaaattgtaacatgatgagtcggttctacatacctcgcaagtgagaactcgccaggtgactgaaaacattcgtgaatgaacaatcgaatggcaggaaacccgacacttcgctaccgaattcgtccgccgtgttttcgagcccctcgcgatgcaacctcaagagcctgtagttcaccctcttccatcagagcccttgtcacttatccagcagatgaccttccttcagtgttatacaaaggctcgattgatcggtctaacagatacgaatattcgctcgggctggaagggatccggcttgtggcctgttaacgtggctttcgtcagcatggtacttttaggatcaagtggaagatgcggacaatcatcgaggaacataatgagattttcttttggatcccacgacaactcgctcatgtcctaccatccagactccaacccttacatcccccttatcctcatctgctgcctcctcttcgtctatatcgactgcctgcgtgaatctggtactgaggcattccggcacctggtgtccggctcgcgcctcctagcctcgttgatggatgtgtctccgatttcctcaccctgcactagaggccgttcaacccgggctcacgccctaggcttcgtcactgacctccacgtccgcctactcctcagggcagcgtttctaccctgagggcgaggtattgaactcagttttatgaggtaaagcgaatgattagggacccgggggctatatattgccttcatccattctcaaactgtaaatatgtaagaagctcttgttgcttaattgaacgtgagcattcgaatgtatcaatactagtgggccatttttggtaacgtgtccgctgtagcagctacattagcggtcctcgtgtccgctgtagcgcttgcattagcggacctcgtgtccgctgtacgagcgtgtccgctgtagcagctacattagcggtcctcgtgtccgctgtagcgcttgcattagcggacctcgtgtccgctgtagcgccttatataactaacttttcttatttctaaataagtataattttagattaaactaaaataaactctaatatattaatactaaacctgaatttatagctattatatatatatttaaagaatttaaatactactacttagggataatatataaggttaagatatatatagattataagaatatttaatagagagtaaaccaaggtctaataacctttggatcttcgcatttggccctctgatagttatatttccgaacccagcgcgtacgaagctctggttgccgcttgataaagttggaagcccaattaactccaacagggggcccccgccaggttggtttctacaataagggcaccaaggctaacacgttcatttaccggaccttagctatgggcataactattttctacctggtttcactctccaatcttttctttgtctcttcgctcaatctccttcaagctgaaaagtatgatatcaaggggtacatgaagttttcgcaccgggcaactgaagcacgctgggacgagtctgctgcaaggtgggctgtcactctccaagactcttaagctgatcagttgagtatagatattgaatatcttatctttaaagctgaaggaactattcaagatctaagacctagtctagggtaggctggttataggatctagccactgtcctcgacttacagcgcttcccaccctctaaaacaataatttaccgcggctcttaacaacttttttgaatctagccactgtcctcgacttacagcgcttcccaccctctaaaacaataatttaccgcggctcttaacaacttttttgcttttacataccctgcagcgcccgcgggacgccctcccatgagcctgggtactcttcagaaatacaccggcccacatttaatgacaacgatccgggtctgagagccggaggccttgcggcatttgggtatgatgatattacatatcgttcgcttgggacttacaaggagccgcgtagcgtcattgaggagttttcgtagggttatactacgttgaattgaaaatgaaatcgtggtaattccagtactcctgcgtcgcggtgacgttgaacaattcggttccatcctcgttcctcatggttgcccagtgactttgaagcgtgacattgtgagatttgaaaacttcctggactttagtggtggtagaggaaatgtggtcgcgcagagttgtcaatgaaagatggcgagcacagtggcagcaggaaatcaggggccgggcaacgttccgacacacccccgagccgacacctaaggtgctgcagctacacgagcacttcagcaaaaggcagagcgccatatacatccagctcaacccgggctcacgccctaggcttcgtcactgacctccacgtccgcctactcctcagggcatcgtttctaccctgagcgcgaggtatgggtgagacgcgtaataataaatatatagataattatattaataactatttaaaagagtatttttatttagaaaataaatatatatatatattagttatagagtataagaagtatattactcctagtaatttagttttattttataatagaagtatactatttctattatttctatcttttaaactatagggtatatataattatataatctattaagagatctttatttataatataatattctctctctattagttttattcttaagattctatataattttaataagttttccttctttctatatataataactatattataatatttattatatctaactatatctaaaagctagtatatttataagatatatagttatattaaaagtaagatataataggaaatttaatataaactttaagaacttaataagaaggagtaattattctctaattaaatctttagcttttttaaaatctctaagtattatattctaaaggaagtttaatttttaaaaattacttttaaaatagatttaaatttattagattttaaaaaggatttttttaatctaatttcttttttttcttctagtagaactaataaattaaatattaatacttctttagatatttaataaatttctatatattattctaattagtatattctttttatttaattagataaaatatttattcttttctaatttttttctttaggattttttctagtttatatttttcttataaattttaattaaataattttaatttaaaatactttctaatacttttttaaataataaaatataaaaagctaaatagatatatattatatctagtagtaaaagtttataattagtatttgaatcccgcactgcgttgtgcagagtatggagcaccgctgcaaaactctggtgatgctcagccgttatcgcaggcaagtcattgtcgtcgcgctcatcaagggggaattctgcatcgactgtgtcgtcgccttctgatcggttggcccagagctttgcgggggcgggcagagcagaagggggtggacataagcatgctggcgtttacgcaaggatccagctgccgacgtcttctgctagacgaggtgcgcggcaacgcaactgaacgcggagacgacggcgggggccccaggcagagttctcttttcttcttaacggtctatcactgcgcggcaacgcaactgaacgcggagacgacggcgggggccccaggcagagttctcttttcttcttaacggtctatcagcctgaacgtgagaattattccttcccgcggattttcaagggacgtcgagagcgcaccagacccagcagaggtgctgggctcttcctgccattaaaccctagctccggacaaaccgatttcagggtgatagaccgttaagaagaaaagagaactctgcctggggccttgtatgggaaatcaaaaaaatcgactcacggccaccaaaccgcgcgaccgatatacatgactttttttgaagtggtgggcagaataatcagcttcgcgagctctttgaaatactggccttctcacttccctccgcttcggcggaaaccagctactagaaggttcgattagtctttcgcccccatgcccatatttgacgatcgatttgcacgtccgaaccgctgcgagcctccaccagagtttcctctggcttcaccctatacaggcatagttcaccttctttcgggtccggcctgtccctaataagccgactccaacaggcttcaagatatgggttctaggccaaagaggctatttcctccgctggctgtggtatataccagattcagcttacggccctgttggtgttgcgctctggcaccttaacctcgcgttcggttcatcccgcatcgccagttctgcttaccaaaaatggcccactagtattgatacattcacagagggaaaggcccggccggaccagtacacgcggtgaggcggaccggccagccaggcccaaggttcaactacgagcttttaatgcggatgcatattacccatatcagtaagcttgagtttctctcttcctttcgtacggctttcttccactcctttacgaagaagaatatccaggcaggctttattggatccggcctaatgccgtacgacccagagagggttctttcaaagctagatgaaaactgcttcccgggctacttttgattttccgcaaaattcattactataggaaatctaaaaaatcaactcacaaccactaaactgcgtaagtgagttgtgctcaaacgaaggcgctgtcgtatatctctcctactagtctctgttgggcccgttggaggatgaggcatgtaattaggatgcaaacttggatttgttatttacgcgtaagccttatcgataagagggcaattaactaataaccttatataactaacttttcttatttctaaataagtataattttagattaaactaaaataaactctgatatactaatactaaacctaacctaataagactaataccagcgatctgtagcgccctgccgaagctgccgccaccaagactcaattctgatattcctcttgcttgggccatacatatggcagctgcttaggcgatctccttgagcgtaataatgttcaattccatcactatcgatgaatttgagcttcctaggcccaatcttcgcaagggtggcttgggctgctccggaaagctctccaaactcggtcatttagaggaagtaaaagtcgtaacaaggtctccgttggtgaaccagcggagggagcattaccgagtttacaactcccaaacccatgtgaacatacctactgttgcttcggcgggattgccccgggcgcctcgtgaataagtataattttagattaaattaaaataaactctaatatactaatactaaacctaatctaataaaactaatatcctaatctgaatataattaaaaatattataaagcttaaataattaatttttaagagctatctctattctaattaacttaatatagtatataatatactaaaactatccgtgttcgtggtcaagcctctgctgtatgtacatcttgccttgagtcgagctagagcccgggacaatttggtgagaacggtcacgtgagcgagacggccaatcagaaatgaagttcacagtattctaagcaaccgatgattggctgggaattgtcgcgctgtaccgactctgggggcttctcggcctccgtctctgcgccggcctggctccggagatgcttccatctgcggaagatggcccagtacaatgcggtcaggaaaccaacagggattgccctagtaacggcgagtgaagcggcaacagctcaaatttgaaatctggcgcaagcccgagttggaatttgtagaggatgtttctggcgacgtgccttccgagttccctggaacgggacgccatagagggtgagagccccgtactaacaaccaacttagaactggtacggacaaggggaatctgactgtctaattaaaacatagcattgcgatggccagaaaggggtgttgacgcaatgtgatttctgcccagtgctctgaatgtcaaagcgaagccattcgaccaagcgcgggtaaacggcgtgttacagttgacccgagacgctgtgagtggtttgctgcagcgccttaggctttcgccttcagcactcgcgcccctctcgcataggtgcaccgacccacatttaccctcgtgcacgccacggtcggttcccgggccacttttgattttccgcaaaattctcatgatccaacccacggatcattgaccaaacctcatgatcccctactatatatgcacattcatttcttagctagaaactctctcttagacagttatcaatacaatcgctaccgccttcattgaaactagctcctcagtgctcgcacattagcagtgaccacagcttcaaccatggcggtgtccgctgcacgtggcgatctcccgttgctcagtggtaagtttagccagcggccatccctccacagaacccatccagcgccggcgagagcagagctctccccagaccaggcatcctcagtacgacgtaccgcacgcggctttatataactcgtgacacagtgcgtgctaatagtcggccctcagatacggacttcagggttagcggcgctcctttcaaaagaaagatccatgctagaggtagctcaatagccaggggaaacctcacacagaagtcctcgaggattcatctagtgacccaccgtgcctttaatgcttccttcccgaatcgatcgcatgtaccactactggtaagccacttatgtgttactagctggatcagacgatgcatgtcataacttccgttgttatcttcagtcacgaaagaaaaggccctttaaatatatatataatagctataaattccttattataaatagagtagttaagttctatactatatagtttctttaagaagaatactataaggtataatactttattattatctctttagctaagttatatactaattataaaatttaaaatattagttttaagttctattttctttataagcggccatccatccacagaacccatccagcgccggcgagagcagagctctccccagaccaggcatcctcagtacgacggaccgcacgcggccgctttcgtgagggtcgacgcccactatgaatcacccgccagcgaagccgaagccgtctagcctgtcgcttcttacatagttaaagtttgagaatggatgaaggcaatatatagcccccgggtccctaatcattcgctttacctcataaaactgagttcagtataggttatgtaaagtataggttaggtggcgtgtgttgtgtgtgaatatgctttggtggcattcccagtgaggtgcaagtataggttatgtaaagtataggttaggtggcgtgtgttgtgtgtgaatatgctttggtggcattcccagtgaggtgcgtgtgctgaagtttggttcccggcgatgtgcatgtgctgtggttggatttgtgattttgttggtttctaggaccgccgtaatgattaatagggacagtcgggggcatcagtattcaattgtcagaggtgaaagtcttggatttattgaagactaactactgcgaaagcatttgccaaggatgttttcattaatcaggaacgaaagttaggggtcactttcattacgcgtaggggtttgacacccgaacactcgcatacgaagacgactccttggtccgtgtttcaagacggctcgttgatgaccattacgccagcatccttgcagagcgcgaacctcagtccaccccagggtattacacagtgggctataagaagaaaagagaactctgcctggggcccccgccgtcgtctccgcgttcagttgcgttgccgcgcaaaacccacatccagggaagaaaagagaactctgcctggggcccccgccgtcgtctccgcgttcagttgcgttgccgcgcaaaacccacatccagctgccggaatattgaccggcttccctttcgccacacgaacccagggctgccttatctcaggcagggtctctggtggtgttggtgttcgcagtgccacatctagctttgaaagaactctctttgggtcgtacggtattaggccagatccaataaagcctgcctggatattttcctctgtaaaggagtggaagaaaggaggagagtcacagttctctgcctcaagaggcagtgtacacagagagctgcatgaagtcggttgtgattatacgccaagaaatgtctcctcttcaggttcagacatgggtattgacgctctcacaccttcgcgcgtgcatagaaccgataaatacaatggcatgtcatgtcctgcctacacaagtacaagagaccaatgcgtactgcccaaattctgctcagaattccgaccccagaccgaaaggggatagagcaaacctaaaactcaccggaggcaaattgtccccaccgggttagatcataggacgatgacttactccgcgccaaactccatgttcatcagccctgtcaatggcctcggacaatgactctgaggagcatctcacaagcccagcatagaggttggagagctattttgatgagctgagattcgggatttaatatgctcagactgtgcgcttgcctcgtacacagtctgtggcgttctaaagctaaataccggccagagaccgatagcgcacaagtagagtgatcgaaagatgaaaagcactttgaaaagaggggtaaaaagtacgtgaaattgttgaaagggaagcgttcatgaccagacttgggcaggttgatcatccgtggttctccgcggccggccctgagtggtggtttccctcctctctgggccagtccggacgcctcactgagccattcaatcggtagtagcgacgggcggatacttattaaacttaaagatatttaaataatatactttatatattaataatatagaatagaactatatactatctttagagaagacttagaagaataccctattaaatatatatataaagaactactagtagaaatatataaagaactatagtataaggtttataacttacaaggagccgcgtagcgtcattgaggagttttcgtagggttatactacgttgaattgaaaatgaaatcgtggtaacaatttttttacctatttctattaccatcttatcaaccgttgcttcattacaacagagacacgacttgctatcctcggcctggcccttgagatagcccaagagcacaacttggtggtctatccaacgcccaatgcgaccacgacttccttctcaaaccatacaatggccaatgcccttcggggctctctggtgattcatgataacttctcgaatcgcatggccttgcgccggcgatggttcattcaaccaatgcccttcggggctctctggtgattcatgataacttctcgaatcgcatggccttgcgccggcgatggttcattcacatttcttccctatcaactttcgatgtttgggtattggccaaacatggttgcaacgggtaacggagggttagggctcgacaccagcggcagggccaccgacgccccgcacggcaatccaccttccccctctcagttccccagggcatccttccaccacaccaagaccactagggccggtgcggcgcagattggtaggtcgggattttgtttcggtaggaatcaggttccaacttggaaatactttcacaacgtaacaaacggacagcgaagaggttgagggactgattagaactgtccgcttcatcatcgactaagttgttgcctgcctgcatttttttgatttcccatacaaatgaattttgcggaaaatcaaaagtggcccgggaaccgaccgtggcgtgcacgaggggaaatgtgggtcggtgcacctatgagagaggggcgcgagtgctgaaggcgaaagcctaaggcgctgcagcaaaccactcaacggtcgtttattactgctactcgcagtgccgtcccgaaaaagtcctcatccttggaaaccttattgatatccaagttggtactcatattggtattgtccaagagctgttggacagcgtcaaacgtcccaatggagcaggcatactgcaagatcggggcggcgtttcggtccgactcaaaatggtatcatgtaacggaagaagcccacatagactcagcatttaggcgatggcctaacaagaatgccatgacttctcggataagattggttaagcaataactcaagaggttagctgtatgttattcgttgttgattgtggtcggtggccactgcccttcactgggtgtagcggggaaacaggacttttactttgaaaaaattagagtgctccaggcaggcctttgctcgactacatcaagtcggattgcttcgcaaaggttgagatgcgcgactcaagaggtattagcgtgctaagtggacctcatcattagaaccgtataatttcgcaaaattcgctgaaaaagggccccacattgcacccttgttcgtatccacaccaaatacacccttggactcacggccaccaaaccgcgcgaccgatatacatgactttttttgaagtggtggtcagaataatcagcttcgcgagcgctttgaaatactggccttctcacttccctccgatccgcgtggaaggcgggagaccggtttgaagttggggtaccgggtagcgcggtttggtggccgtgagtcgatttttttgatttcccatacaaatgaattttgcggaaaatcaaaactggcccggggactgaccgtggcgtgcaagagggtaaatgtgggccggtgtaattaaaatctaaaaaactaataattagagtaaaatataatagtattctaatagttattaatagatttataaagtatagatattttattctatataaagaaataagctctatagaaaactttatatattaatttctataatatagaatataattagtagtctatatctaaacctttaatactataagataaagttaaatattatactttcagcctaggtataagtattaataccttaaaaactctaataataagagctatttatatagccagatatataaataacccagctatagctatagcccctaagaggggaagcttattatctaatagaggttatgtaaagtgtaggttatgttgagtataggttatgtaaagtgtaggttatgttgagtataggttatgtaaagtagaggttaggtggcgtgtgttgtgtgtgaatatgctttggtggcattcccagtgaggtgcatgtgctgaagtttggttcccccagaaaattatactaatttctcttataggtctaccgactaaaaactactctaaaacccgctaaagctgcttcccgggctccccagggtattacacagtgggctataacactcccgagggagccacattcccaaagcctttatcccccggggcgaactgaccccagggtattacacagtgggctataacactcccgagggagccacattcccaaagcctttatcccccggggcgaactgctgctggcctgggcagggatattctcagacgacctaacctatacccaggctaccctataaccagcctaccctagactaggtcttagatcttgaataattccttcagctttaaaataccactagattatttttttttatactaaataataaaaatattattaataatattataaaacaacatacaataataataaaatataaacctgggaaagtttgatttatatatattataaatattatgtatacacaattatatatagttacattatacatctctccgagagaccgttggaatatggatgaagccggtattatggagggagtcagaggtaacgggctggtactaggatcattataatgagccattcgcagtttcgccgtataattgcttatacttagacatgcatggcttaatctttgagacaagcatattactactggcagaatcaaccaggtaactatcgttcgccggggttggccaccagcgcccacgaggggcactggagaattaggtaatagcaatgctacaccaagatgatgtaagaccctttgcgtctatcaagcatccagtggtttcctttctattgtcgcacggtagcgatgccgcatgagagttggtcaaagccacaagtaattttgatactgaagcctccatttgcagccagcggctcaggtggattgccgtgcgcggcgtcggtggccctgccgctggtgctgtgttcggcgcgctctcacgagtgccattcagtaacagcctgatgttgagagcatatctaccatgtgcatcctccgtgacaacctatccctttggatatctcctgacaatggtcatcggggagcctcaacccaagggaaattaagggagaagctttctgcaacatgttaaaatgaatgaaatataggtatcaactgagagtcatagttactcccgccgtttacccgcgcttggtcgaatggcttcgctttgacattcagagcactgggcagaaagcacattgcgtcaacaccactttctggccatcgcaatgctatgttttaattagacagtcagattccccttgtccgtaccaccactgagtatgcaatattcttccgccgtgttgggccgcggtatacatgtgcctggtgcctcgcgatctgcacccggtggaagaatatcttctcctcccccggtgggagcgttgctgtcagaaacacaagctgcaggcacgtcgccagaaacatcctctacaaattacaactcgggcttgcgccagatttcaaatttgagctgttgccgcttccctcgccgttactagggcaatccctgttggtttcttttcctccgcttattgatatgcttaagttcagcgggtattcctacaggtgggcttgacgaattgaggaggaagaggcagcgcgtacggaagccacgaacctctaatgacgataataccgataccgccataattgtcgcgacgagctgatcataatggtataattttcatagctattggagttgaatttatatagtaattattaaggacggaaatgtgagaacaagcctcggggttagcagtgtaagctcagggcataccgtttgaagtacacagggtgctcgttatggtggtcgtcgctgataaatccttgaaaaatcggcacggcgtactcatgaggtcggcggagcttctgcaaccagccatggcacggcagacaaatcactccaccaactaagaacggccatgcaccaccacccacaaaatcaagaaagagctctcaatctgtcaatcctcatacaactcagcgaatcattcgctcgagccattgcacaacggtgggaaggcctcgtattgaaaggttgcgacgacccatacttctcgttcgacacaagcaaatcgttcatcaagctaaaaaaggattatattccaggccttggagacactgaggcaggcttgatacgctgatggattttgacgaggagcttacaactcggtatcttgtattgtaagtcttgtcccaacttacttggaatatatctccaacctggttctataggacatgtaatgttattcatgctgtacggagccgcatgcaagaagctggggtctagaaaatccgggaaaaatcctaggatattctcagacgacctaacctataccaggctaccctataactagcctaccctagactaggtcttagatcttggataattccttcagctttaaagataagatatccaatatctatactcaacggtctagaaaatccgggaaaaatcctaggatattctcagacgacctaacctataccaggctaccctataactagcctactctagactaggtcttagatcttgaataattccttcagctttaaagataagatatctaatatctatacttaactgatcagcttaagagcctctttcagataaaatagtggtcttggtgtggtggaaggatgccctggggaactgagagggggaaggtggattgccgtgcgcggcgtcggtggcgctgccgctggtgggggcgcccaagccgcaccggccctagtggtcttggtgtggtggaaggatgccctggggaactgagagggggaaggtggaaaactatagttttagaatataatatatatatataaattaaatctatataatataaactatatagagaatttaaactagtcttttattttggaatcttctgagtagtttttacaaataaataaaaactttcaacaacggatctcttggttctggcatcgattaagaacgcagcgaaatgcgataagtaatgtgaattgcagaattcagtaacctgcacctcacataacctgcaccccacaggctatctcaccgcctgtagctcacgctcagtagaccggccctccctgaggcccattgcctttcgatattgctggttagtcttcaagctacctcgaggcagcttgttataccacgccgtacgtgctgtaatgtatcgatggtatatagcacaaggatggtcataacgcatatctgactccgccgatggcggcatatctggcgatggatgatatgcttaagttcagcgggtattcctacctgatctgaggtcaaccttggaaagttgggggtttaacggcaggggctggtcgctctccgatgcgggataagggaagtcggcaaaatagatccgtaacttcgggataaggattggctctaagggttgggtacgttgggctttgggcggacgcctcgggagcaggcagccactagccgggcaaccggccggcggcagccagcacctgggtgctgatgcccttagcatcttcctttcgtacagctttcttccactcctttacagaggaaaatatccaggcaggctttattggatctggcctaatgccgtacgacccaaagtggtacggacaaggggaatctgactgtctaattaaaacatagcattgcgatggccagaaagtggtgttgacgcaatgtgatttctgcccctgaagggcctcgcaagccgggacgcagataagtacaggcggacggcctgtcggttcaaggcgccctggaagatcgtcgatgcgacggggctcaagtagtaaggtactatcaaataaacgataacttatataatgagccattcgcagtttcgccgtataattgcttatacttagtttagccagcggccatccatccacagaacccatccagcgccggcgagagcagagctctccccagaccaggcatcctcagttcaaaaaaatcgactcacggccaccaaaccgcgcgaccgatatacatgacttttgtaaacccgccatcccatctcttctcagctaccctgaaggctatatcgcctaagatactggagaaggagatgtgcgggatgtaaagatagactggctaccctgcacgaatgtactcacttatttcataagtgggctttgatacctattggatttagcatttaatgaacttaacctacgatgaatattaatttcgcatcgcacttcatccaccccaagccagccaatagcaaaattcatttgtatgggaaatcaaaaaaatcgactcacggccaccaaaccgcgcgaccgatatacatgacttttgtaagcaaaattcatttgtatgggaaatcaaaaaaatcgactcacggccaccaaaccgcgcgaccgatatacatgacttttttaaacccgccaaatctatattatttctaataaaaaccttctatagtagtaaatatatactatacttatagagataaattaactaataaccttatataactaactacggcaggggctcgtcgctctccgatgcggaatatcactacttcgcagaggaggccacgacgggtccgccactagatttagggacggcaggggctcgtcgctctccgatgcggaatatcactacttcgcagaggaggccacgacgggtccgccactagatttcggggccggccgtccctcgcgggctttggccgatccccaacaccacgccctaggggcatgagggttgaaatgacgctcagttatagcgaacttccctgctgcgttatagcggtctcaaggcccaatacaccttgaaggccactgtaatttgaacacttacagctctcaactgctaactccgctattactcagtgagttttagtgctagagggacctaatatagtgcaaaatatccgtggtaattctagagctaatacatgcttaaaatcccgacttcggaagggatgtatttattagattaaaaaccaatgcacttcggggctcttagatcgggcgatcgaacaaagcggcaacgaacacataaagcatatcagagtagcctcaactaaccagctcaagagcggcgatttgagcatcaagacagccaccaccgaggacatggaggcattaagacagtttgctggagagccccgtacggttggatgcctagcctctgtgaaactccttcgacgagtcgagtagtttgggaatgctgctctaaaggggaggtatacgtcttctaaagctaaataccggccagagaccgatagcgcacaagtagagtgatcgaaagatgaaaagcgaccgggcgccagaactctggcgtccttgtaatccatctcccaaaccccctacgcagccagccaccagggccgcctgtagtggggaaatcgaggcgaaggacggcttaccctcagcagatcgtaacaacaaggctactctactgcttacaggaccgtttattctatttaattattactttatagatagtaagctattaaaagcttatattttatatctatttatactataagtaattactagaataacaacgtcagtacggtcgtttattactgctactcgcagtgccgtcccgaaaaagtcctcatccttggaaaccttattgatatccaagttgtctaagttttagtaattacttatagtataaatagatataaaatataagcttttaatagcttactacttataaagtaataattaaatagttttggctgctatggatcaattttcgaagggtacatgcggaactatgcacaagatggccctcttgaaagcggagaaccaactacttcgagaggcaaatgcaatactaagcaagcgccgtagagctaagagaacgcgtctacgccaaggtggcagcatgacactgggaatgccaccaaagcatattcacacacaacacacgccacctaacctatactttacataacctatactcaacatacctagggcaaacccgccctttttcctgctacgcgtttttcctcctcttcaacaccgcactatcattcacaaagaaaaaactcactgcaaccatttgaacaaacacttcccagcccaagatggtcgccctgacgccgggtatagggtagctggttgtggtttctgcctacccggtaccccaacttcaaaccggtctcccgccttccacgcggttgagtgtggaacgcacgcgatgccgttttggtgtcaagaagtttcctgggctatatttaattagaaacccaaggatgactattattaggttatcgggcttatcaagcccagataagggtctaataaatccgggaaaaatcctaggatattctcagacgatctaccgggttgaagacattgtcaggtggggagtttggctggggcggcacatctgttaaaccataacgcaggtgtcctaagggtggctcatggcgatggccagaaagtcgtgttgacgcaatgtgatttctgcccagtgctctgaatgtcaaagcgaagccattcgaccaagcgcgggtaaacggcgggggattgaggctggatctgcggccgagtctgtgtctgcacactggctccagatgagacatgaagtctttgcagaggctggggtggtccctgaggaggtggtccctgaggctgaggtagttcctggggtcgaggtagtccctgaggttgagctagcactggacagaaagactggactagactgtgggagtgaatctgggatttatctaaaagagactcttaagctgatcagttgagtatagatattgaatatcttatctttaaagctgaaggaattattcaccaccgacgccgcgcacggcaatccaccttccccctctcagttccccagggcatccttccaccacaccaagaccactagcgccggtgcggcttgggcgccccaagaggagtgctcagcgcacagcttcaaccatggcggtgtccgctgcacgtggcgattccgctgtacgagaaccttagcacttagttagcgaacctcgtaaccactgtagcagctgcattagcggacctcgtgtccactatagcgctcgcattagcggacctcgtatctatttgacctgtgtggtgcctttggctttggcttttgtgttgcctttgacctatgtggtgcctttgcctttggcttttgtgttgcctttggcttttgtactgcctttggcttttgtactgcctttggcttttgtgctgcctttggcttaggcgttgcagctttattcaggactgcagttttctttagagcaggtggcttcagtgcgcccttatgagcagggctacggggggctagagcagaattaaagccgggttgaggaccagccttaaagttgtcgttcttcttcccctgtgccaatttcctaggttgtccttccaaaatattctcataggcgatcttactcctggaacttaggtttccgacatgatttccatcgtactcatgatggatttcatcgattctttctgcccaagataccgatatagccagaagaagaggaagcacatagaacctcatagttgcagtgtttaaccgctctggtgtaataagaacagggactcgacaatatatacaacaagaacgaagggataaaataatatagaagaaattgattctgttgcattgtagcatgaatagataggccgtgggatctgaggttgcggatttctctggattttgtagataagtcgcctgcctgtattaggataaccattagcaccggccaatacttgcagtacaagatggcaacggattcagacgggcgctagtacagaagcagtatcgctgtagtcattttagccactaaaatagcagacttatatataataactctgttcagccaatcatttgaaattcatgagagaaagtttcctgcaaatgatggcaaaattctacagaaggagtagtatcatgcagtcatcatgcggtcatcatgcggttggtcatgctcgtcgccccagggaggtgggggagcaggcagaggatccatttcggctgagactgggtgagtcagactggcacaggctaaattggtcgcagcccctctacttggggggatgcaaaattttgcatccccccatgtgctcttctcgcggattcacacgccatccagacacgactaacatccaaccagtctgatatacaaaatattcacccaagaattaaaaccatcaaagacccgttcatttgcgacgctggtatctatcgcaatgtcttccttcaaaaatacccttcacgattacaaacaacgtatcataaatgcatttgcaattccttcagattataaatcccccaaggaagaacaacaggaatggcgagatacctgttcccaagagacagtcctttccggcttcacatattttctacagaataaaactagcgactccgccccaattttcaatccaactgaggttaaaaccttgcaagaaatattcagcaattatgccaacccagataactgtatttcctcccttttctcctttactactactttacggataggataaattaacaaacctttctatgtaggctgggatctacaatcactagaagcctacctccttacacaggtccctcaagagcgtgatgttaagaatctcttaaccagatctatgccgtctctttgggctttaacgacctacttcgcccattggcctttcaatactgccatatcgactccagtacctagtctaacgttccctgcattcgttcgcgccatcgcctttctctgcggcaggcactctaggatgttttttaactggaattatgagaataaaaaattcattcgtggtatagacaagctagttctacagcacatctttcgagcgctggctactgtccgaccaaaagaccagcaatccggtgcacctccgcttaccgaggatactaacttactatcacaactcgatattattgatattttaaccgtagctcaacccccggaaatcattcatgcaccctgcactattgtgagagccactctgaggcaatgggagctgattccgatagcgaatcggttactgttaactccttcgcctgaattatcagatctaactatctcaaccactgagatgcttgttcccctcttagatctattgatatcacttctagagtgtgcaagcttgtctggaaaggatgttatcagatcgcttaagacagagctaaaggcttctcgaatacagctacgggaggaagaagaggtatcatttgatatctatgcaaaatattttgattatcatgacgagaacaagtgggtgaaggaggataatgaaatagatactatctatgattgtatcaccgtgctgtttaacactattctaaaccctcgaagtttaataactggcataacacgcgattggtcttcaggtgctcaaaagaacttacgtcttggctcgctacgaccggaagttttatggtagcatggtgtattattgaatctgtgttttcagtgggcagaagttatctagcttttaatttatcaccgggaaagtctgtatactgagactgagtaataaatttggcgtcttattatactaaaaagagcaaattgctggcgccttcttattatactgaaaagagtaaatagctgggagcagtgtttataagtatatttatactatctatagcttcctagaaatagtactagtctgtatattactagttatagttaagttaattatagatagctatacctaggcttattattctatataactttttaatacttggaaaaaaataattaaatataatatagtatattttaaggctatatctagctctttaatatagttaatagaaagattaatagttattataaatttaactaatatatagtattatatatagactctactttttctctctaattataactaaattatttagattttatattaatccttataattcttaaacctagattattactaagaactaataattctctagtatttttttattagttttactataaataagaatatatcctaagattagataatatataatctaatatatattttttaaaaatataattagtagtctatatctaaatctttaatactataagataaagttaaaatattatacttttagcctagatataagtattaatcttataaaaactctagtaataggaggtatttatatagctagatatataaataatttagctattactatagcttctaaagagaaaagcttattatctaataataataactatattttctttttaacttaaaacttattataattaattaattaattatatcttactattaattacttaattaattaattactagatatctaataagtacttaaatagttataatatttaatataaatattctaatcttttagaatctagttaatatttttaataagatttttaaagtaataataataattatctaaagtaatctaatatagctatttactaaatatatttataatatatttctctaattagttaagaacctatttataataataaaattacttttagtattatagatctagtagctatatctacttaatctattactttatataacctactatctataactattattataagaacttatagaaaattaaaataagtttaaataaatactatatcttaagaataactactctcttatatagacttactatagtctaatatataacttatagttttaatatattatatactatattaagataattagaataaaaatacggcgtggcgacgacgaggatgaggatgagggggaagataaggactagtgtatgaaggctgataaaaactggcattgagtttctgcttctattggtacgttggtttcttttcttcttcctcgatgtatcctgtgaatatgcgactatctcgtctgcgctcgtacagcggacacgaggtccgctaatgcaagcgctacagcggacacgaggaccgctaatgtagctgctacagcggatacggttgctgagaagactcctgtgcaggcgggaagtctgtcctgctgaagccgcttcctttgcgcctcaaccttccgtaatgtatcgtgagatacccagcctcgtataatgctgtatagactccctgagagttcgataggcgtccggacttgctgcttcgcttccaagttctggttttaaggtccttcgcgggccgacccgggttgaagacattgtcaggtggggagtttggctggggcggcacatctaattaagtttattatacgagggataggtaaaagtggccgactcacttgtgtggccgactcacctgtggattacgttaagcagtattacatttatctgtacggacggagcctcgtaactgtgacaatccaccacagctttaatataacatatagtataccagatatggaaacacaacgccgactgcctagggagaatcggcttcggggggtcagagccggggtatggcgtagatagcccagaagaacgaaaaacgagaatgagcccgcgaaaagcgatacagaaggctatacgggaggagcaaggattcaatctggaacaaatagaagtaattcctccacacgtcgtcccgccatggtggacgggcccaaggacatttatcgaagagaatgccgagaaggcacaagcgaagctcttggcaaggccatgaaatggtccaccagacacgcctctatcttcgcaccggaaaaattccagctcatacacttcacaagggctcggaagaggttcaacacccaccatgctctgtgcacaccatcggccaacgtgcaagccaagcccacttgcaagtatctggggttaataatggatacagggggcatagggttccacagagggaaaggcccggccggaccagtacacgcggtgaggcggaccggccagccaggcccaagggtcaactacgagctttttaaccacaacaactttaatatacgctattggagctggaattaccgcggctgctggcaccagacacccaggcctttcggccaagggagtactcgctggctccgtcagtgtagcgcgcgtgcggcccagaacatctaagggcatcacccaggcctttcggccaagggagtactcgctggctccgtcagtgtagcgcgcgtgcggcccagaacatctaagggcatgacaaatggcagatacaatgctgaaggtgtcctggcagtcattaaggcggcggagagatgtcgctccccagccatgatccaattcttcccctggaccttgcacttccatggccctgcctttatcaagtacgcggtcgacttcgctataacttacaactctcaactgctaactccgctataactcagtgagtttcagtgctagagggacctaatatagtgcaaaatatagcgcagggctggaggaggcattttatgatgaggcttgataacttctgagcaggataccgaggtcttggggtggcaagtaaacagggaagtaatgtaaatgaaaatccatccgagaacatcaggatcggtcggagatgcgccgaagctctctcctacgttcactttcattacgcgtaggggtgtgacacccgaacactcgcatacgaagacgactccttggtccgtgtttcaagacgggtcgttgatgaccattacgccagcagacacaatgaggattgacagattgagagctctttcttgattttgtgggtggtggtgcatggccgttcttagttggtggcgtgatttgtctgcttaattgcgataacgaacgagaccttaacctgctaactagcccgtattgctttggcagtacgctggcttctagaaatgcagggaagaaatcttcctttgtaatataggtaatccgtgccttcataagatgctcaatttggcggccgtaggctgtttttaatgggccaaaaacgcctacatcaagtggctgaagaatatgagaggagtgaggaggcatacagagagacctagctaatttcacctctcaatctcaagctacactaggtcgtttctgggccaaattatccttgatcaactgtgtcgacgtcaaatagtacgccttgtccgcatttggatcgtggtcggcctcagtgtggctgcctgctcccgaggcgtcctcccaaagcccaacgtacccaacccttagagccaatccttatcccgaagttacggatcccatcagtaacagtaattacccagtggttgggcacctgcttttagcgttaaggattttggtcctttagactaggcataggtgcttacagaactgagctgatcaaggatgtagcgggtgtcagggcatggcgctaggcagacgggtgcagctgtcgtatctttaaaacaagcaaacaaatgtgtgcggctaatgacagtctggcaagctcaccgtctactagttagtaaacatcccgtttactacagcatcaaccgacctccgttatttcctgcttttaaatctacattcttgttgcacatatttcgctatcgtatgggtttgatggaaggtcatcttgctgattggtgatgaatcaattagaatatccttcttcgcaagctcctcgcgataggctctcttaaccagtgaaaaaactgatatatcaagcggctgtaatacgtgcgatgaatgcgaaggtaagaaaagaaggaatatatcgttttggggaatgctgctctaaatgggaggtatacgtcttctaaagctaaataccggccagagaccgatagcgcacaagtagagtgaggaaggtcatcttgctgattggcgatgaatcaattagaatatccttcttcgcaagctcctcgcgataggctctcttgactggcgaaaaaactgatacgctgtgagtggtttgctgcagcgccttaggctttcgccttcagcactcgcgcccctctctcataggtgcaccgacccacccagaggccagtcaggggcatacatactccagattataacacaacaactgcaggaactgcaaatacaaggccttgccgtggagatccgatggatcccagcccacaaggggatagatggcaatgaactggctgattgcgcggctaaagaagccacattcatttgtatgggaaatcaaaaaaatcgactcacggccaccaaaccgcgcgaccgatatacatgactttttttgaaggggtggtcagaataatcagcttcgcgagctctttgaaatactggccttctcacttccctccgatccgcgtggaaggcgggtttgcctcggagaaaagagggagttttttgtcggaggagcgccgggtatccaatccgcaggctgaatgcaacgttgtgccaccgatatgcgccgctgcgctccccgacgttcccgtgatgcggagaagatgcgattggcctctggccgaaaagacccatttgagggcctcatgtcgtcgtcgaggaagctagcttcgcgacctacccagacctcaatggcaaagttgtattctgtatgtgacacaacaccctctactgcctgctattctcaagcgggatgagaattcccaaagaattgcgatggccagaaagtggtgttgacgcaatgtgatttctgcccagtgctctgaatgtcaaagcgaagccattcgaccaggcgcgggtaagtccttcatcgggacccaaagcaagacaatggcactaatatactacttgacaaactacgctacaaaggtccaagatccggcctggaagagagtggccatagcagcagagctttttccgagtatcagcagtatgattattatcgagtcttcgctgacgatgccacttatcatcacggtcatggacatgcttattcgaactatgagatcgacaaggagtcgggttgcgctgtaataacccggccggatcagtacgttggttggatgggcgaggttgatgatgtgaaaatatattaaaactataaattatatattagattataatagatttatataaataaatagttatttttaaaatatagttttttttctaattagttttttttctttataagtatttataataatactaaataaactatataataaagtaataaactaaatagatatagttattaaatctattttttttaactataaataaaattattctaaaattagatataatatataatttatctattatatagggtttttttatatatataattagtagtttatatctagatcttctatagcgaacgatagttacctggttgattctgccagtagtcatatgcttgtctcaaagattaagccatgcatgtctaagtataatcaattatacggcgaaactgcgaatggctcattatataagttatcgtttatttgatagtaccttactacttggataaccgtcgggtcaactgtaacaagctggtccgatccgctgtgggaaatctcttcaactgtaccgtatcttgcagattcccactgggtggtcacttggacaggctagacggcttcggcttcgctggcgggtgattcatagtgggcgtcgaccctcacgaaagcggaatcactccaccaactaagaacggccatgcaccaccacccacaaaatcaagaaagagctctcaatctgtcaatcctcattaatcactccaccaactaagaacggccatgcaccaccacccacaaaatcaagaaagagctctcaatctgtcaatcctcatggtgtctggacctggtgagtttccccgtgttgagtcaaattaagccgcaggctccacccctggtggtgcccttccgtcaaaatcactccaccaactaagaacggccatgcaccaccacccacaaaatcaagaaagagctctcaatctgtcaatcctcatcgtgtctaactaagaacggccatgcaccaccacccacaaaatcacgaaagagctctcaatctgtcaatcctcattgtgtctggacctggtgagtttccccgtgttgagtcaaattaagccgcagggcctggctggccggtccgcctcaccgcgtgtactggtccggccgggcctttccctctgtggaaccctatgcccttcacggggtgtagcggggaaacaggacttttactttgaaaaaattagagtgctccaggcaggcctttgctcgaatacattagcatacccgctgaacttaagcatatcaataagcggaggaaaagaaaccaacagggattgccctagtaacggcgagtgaagcgtcaacagctcaaatttgaaatctggcgcaagcccgagttgtaatttgtagaggatgtttctggcgacgtgccttccgagtccgtactcttgacgaatggtatttcaacgagatgagcacaattaatcacaatgcgtattaatagtctaaagtgctagccaagaaagaggctgtggaatacccctctaggattctaagtgggacttagcgaagatttgccctaggtttcaattggaccatgtctagtcccgaattccagtcgcagcctggatgtgggtcttgcgcggcaacgcaactgaacgcggagacgacggcgggggccccaggcagagttctcttttcttcttaacggtctatctatactccagtgaattattggacatgaacaactcagaccctttcgataccttgccgattaaaatgacctcaaactccaagcggcttttgcactattgtacgtgtgtaggatctcgcagatacaacagcagctgatccccgatggctagtccagcacctcagagtcgacttcgaaacctgccctaaagggttggagacaggctggtaagttagacactgtcatctaatgatagtgcaaatttcgggctttctcatccatgagacgcattggccgaagaaacggagtcgctgacaatatcttcattttcggtgctaagcttaatcccgagtaaatatagaatgcgtgagctataataatttccaaagcaaatgcaataaaatcaaatataatatataataaaaactcgttcaagatcatttgatagtagtccatagtggtcagccaagcatgagctttcattcaagtgttatggcagttgagctacactctagtgcatgacatgctgccctttaactgaaaaattcatttccatctgtgccgttgacctcagaatgagaatctgtcaaaagcgccgctaaagtataacccaacccgggtccctaatcattcgctttacctcataaaactgagttcaatactgctatcctgagggaaactgcggcggaaaccagctactagaaggttcgattagtctttcgcccccatgcccatatttgacgatcgatttgcacgtcagactaactatatactaactctaaatactctctaactctaaccctaagtaaccctaatactccctccccctaaccctatactgctctaaaatactctctaaccctaaccctaagtaaccctaatatcccctccccctactaactatatactaactctaaatactctctaactctaaccctaagtaaccctaatactccctccccctaaccctatacttctctaaaatactctctaaccctaaccctaagtaaccctaatatcccctccccctaactatatactgccttaaaatactcgctaatgcccgccaatttcccttataaacccggtgttgcaatccctctgaagcccgaagttgatcaccgatatcaacaccaccagggagggccggtctactgagcgtgagctacaggcggtgagatagcctgtggggtgcaggttatgtgaggtgcaggttaggtaaagtgtaggtcatgtgaggtgcaggttatgtaaagtgtaggttatgttgagtataggttatgtaaagtgtaggttagtaacaacaaggctactctactgcttacaggaccgtttcgcacagctaagtcgtctgcaaaggatttgaccccgctcgtgttaaaattacaatacgcgaaatactacagcacacttctagtaccgtagagtaatcgcctgctaagacgctaagccgaagtctagaattaccacggttatccaagtagtaaggtactatcaaataaacgataacttatataatgagccattcgcagtttggccgtataattggaaggatgccctggggaactgagagggggaaggtggattgccgtgcgcggcgtcggtggccctgccgctggtgctgtgtgcggcgcgctctcacgagtgccattcagtaactaattctccagtgcccctcgtgggcgctggtggccaaccccggcgaacattgagagtctcagatagcgtcggtggtcctttcccatgccgtcagttcccaatgatcccgatggcttgcccgatccattatcacactgtcccgagccgcgacctggcaaggagctttccattgactttcgtggatataggtccatctcgcaatccctcacgggacgccatagagggtgagagccccgtacggttggatgcctagcctctgtgaaactccttcgacgagtcgagtagttacgggacgccatagagggtgagagccccgtacggttggatgcctagcctctgtgaaactccttcgacgagtcgagtagtgtgggaatgctgctctaaatgggaggtatacgtcttctaaagctaaataccggccagagaccgatagcgcacaagtagagactggaagtcagccatagcgtgtatcaccccgctaaaattccaaccccagcgcacccaacccactacataatcaaccacacgtcgctctccgatgcggaatatcactacttcgcagaggaggccacgacgggtccgccactagatttaggggccggccgtccccgtcgctctccgatgcggaatatcactacttcgcagaggaggccacgacgggtccgccactagatttaggggccggccgcccctcgcgggctttggccgatccccaacaccacgccctaggggcatgagggttgaaatgacgctcagacaggcatgccccgtcgctctccgatgcggaatatcactacttcgcagaggaggccacgacgggtccgccactagatttaggggccggccggccctcgcgggctttggccgatccccaacaccacgccctaggggcatgagggttgaaatgacgctcagacaggcatgccctaggagtcgtggtatttcaccggcgccgaagctcccacctattctacacctcctatgtcttttcacaatgtcaaactagagtcaagcgccgccattctcagagcaagccattggatttggaccagcaacctcgtcttatccaagtcctcctccttgaccctgatcaggactgggcaggcagagtgcaccgcggagaaccacggatgatcaacctgcccaagtctggtcatgaacgcttccctttcaacaaagccatcaaccagaccgtctttagcctgtagatcaaggcctaagaccatagcaccttcacgaataaaggtttctagaattccacgtccgaagccctgggtagtgccggaaacgagggctactcttccttcaagacggccaggcatatcgactgtacggtaagggtcttccacaaaggtccgcctcaccgcgtgtactggtccggccgggcctttccctctgtggaaccctatgcccttcactgggtgtagcgggggaacaggacttttactttgaaaaaattagagtgctccaggcaggcctttgctcgaatacattagcatggaataataaaatttattagattaaaaaccaatgcccttcggggctctctggtgattcatgataacttctcgaatcgcatggccttgcgccgtcgatggcaggttatgtaaagtgtaggtcatgtgaggtgcaggttatgtaaagtgtaggttatgttgagtataggttatgtaaagggtaggttatgttgagtataggttatgtaaagtataggttaggtggcgtgtgttgtgtgtgaatatgctttggtggcattgttctttcaaagctagatgtggcactgcgaacaccaacaccaccagagaccctgcctgagataaggcagccctgggttctaaagaaacgtggccaaacccttgatgagcccgtatgtgatgaagccggtgtttgggcccttccggccaccttcaactcctccctcaactcctcctatatatacctaagaaagtataaccagcgatattaaaaataagaatattatacttacccttaatcttcttatcaagaccataggcaatagcagcagcagcaggctcgttgatgatatagaggatgttaagaccggcaataagaccggcgtccttggtagcctgacgctgggagtcgttgaagtaggcggggacggtaacgacagcgttgttgacggtgcccgcgcaaaacccacatccaggtgccggaatattgaccggcttccctttcgccacacggcgcaaagtgcgcctttgaaacgggcggctgtctctttagcaactaaatctttagcgcttgagtttgctaaggatcaactccgctttaacactgtctgccctacctcgggaaacacaccgctacttagcacatttgcaggtgacgcaaacggtcccgtcacagaggaaatcatccgggcaaagggagcggctattcctattggtcgaatcgcagaaccttctgatgtagctaatgctgccttgtttcttgcctaagaacggccatgcaccaccacccacaaaatcaagaaagagctctcaatctgtcaatcctcattgtgtctggacctgttgagttgaatgtcaaagcgaagccattcgaccaagcgcgggtaaacggcgggagtaactatgactctcttaaggtagccaaatgcctcgactatatataaatagatattagattaatattaaatctatattattcctaataaaaactttctatagtagtaaatatatattatacttatagagataaattaagggcgccccaagaggagtgctcagcgcacagcttcaaccatggcggtgtccgctgcacgtggcgatctcccgttgctcagtggtggcctatcgatccgttagtccttcgacgtgtgaagctagaggtgccagaaaagttaccacagggataactggcttgtggcggccaagcgttcaccccacaggctatctcaccgcctgtagctcacgctcagtagaccggccctccctgtatctagccactgtcctcgacttaccgcgataattatcaaccgaaccttggttgatgacgagttggccgatggaaattgtcaaatgttccatcattatcccaataattagtgtacaagatcagagatccaagcacaccgctcccagaggcggtaagcagctgcattctgcatgattggcgaggaaaaggtctcagaggcacgtaatatggttattcagaggaaggaagacgatattgcgaaggcgaaggctgtgttagataggcagcgctgccctcaaatcaaacaaatcaaatccggagtcatatttgatttatttgatagccctcaacgtcggatttgttgaaattacagtggccttcaaggtgtattgggccttgagaccgctataacgcagcagggaagttcgctataacttacatctctcaactgctaactccgcgccatgcaccaccacccacaaaatcaagaaagagctctcaatctgtcaatcctcattgtgtctggacctggtgagtttcgccgtgttgagtcaaattaagccgcaggctccacccctggtggtgcccttccgtcaatttctttaaaaaaaacgagctgtttctctccatgaactcgtgatctaccaacggcacgccatatcgggttctcgacagacgcacagcacgtcttgctctgcattgttgttctgattgcaatttggaaacttccaagaggagttgtaatctctctcccaatgtcatccatcccgagccctgtatcaaagaagaaaatcctttgcagacgacttagctgtgcgaaacggtcctgtaagcagtagagtagccttgttgttacgatctgctgaggggaagccgtccttcgcctcgatttccccaatacaggcggccctggtggctggctgcgtagggggtttgggagatggattacacactggctgtccctggacatactggctgtccctggacacattagctgtccctggacacactggctgtccctggacacacacactggctgtccctggacatactggctgtccctggacacattagctgtccctggacacactggctgtccctggacacattagctgctggataagtgacaagggctctgatggaagagggtgaactacaggctcttgaggttgcatcgcgaggggctcgaaaacgccgcgttgaagacattgtcaggtggggagtttggctggggcggcacatctgttaaaccataacgcaggtgtcctaaggggggcattaccattgcggcgaggtcatcagtagggtaaaactaacctgtctcacgacggtctaaacccagctcacgttccctatcagtgggtgaacaatccaacgcttaccgaattctgcttcggtatgataggaagagccgacatcgaaggatcaaaaagcgaattaccattgcggcgaggtcatcagtagggtaaaactaacctgtctcacgacggtctaaacccagctcacgttccctatgagtgggtgaacaatccaacgcttaccgaattctgcttcggtatgataggaagagccgacatcgaaggatcaaaaagcgaaggttatgtaaagtgtaggtcatgtgaggtgcaggttatgtaaagtgtaggttatgttgagtataggttatgtaaagtggaggttatgttgagtataggttatgtaaagtcgagggacggccggcccctaaatctagtggcggacccgtcgtggcctcctctgcgaagtagtgatattccgcatcggagggcgacgagcccctgccgttaaacccccaactttccaaggttgacctcagatcaggtaggaatacccgctgaacttaagccgagggacggccggcccctaaatctagtggcggacccgtcgtggcctcctctgcgaagtagtgatattccgcatcggagcgcgacgagcccctgccgttaaacccccaactttccaaggttgacctcagatcaggtaggaatacccgctgaacttaagctccattctcaaactttaaatatgtaagaagctcttgttgcttaattgaacgtgagcattcgaatgtatcaatactagtgtgccatttttggtaagcagaactggcgatgcgggatgaaccgaacgcgaggttaaggtgccagagtagacgctcatcagaaggcagcaggcgcgcaaattacccaatcccgactcggggaggtagtgacaataaatactgatacagggttcttttggatattgtaattggaatgagtacaatttaaatcccttaacgaggaacaattggagggcaagtctggtgccagcagccgcggtaatcaaaactggcccgggaactgaccgtggcgtgcaagagggtaaatgtgggccggtgtatttctgaagagtacccaggcgcatgggagggcgtcccgcgggcgctgcagggtatgtaaaatcaaaaaagttgttaagagccgcggtaaattattgtttttggcgtgcacgagggtaaatgtgggtcggtgcacctatgagagaggggcgcgagtgctgaaggcgaaagcctaaggcgcggcagcaaaccactcacagcgtctcgggtcaactgtaacaagctggtccgatccgctgtgggaaatctcttcaactgtaccaagatggacagcgatagtcacttggtctggtgtggctgtcttcttcggaaacccgccatcccagttcccacccgagatgccgcctccaaagcccagcaagatagtcatctttcactgtcagggctttcagcttggccaaacccggcttaaagagcgggctttgcagccggttagtcgaaacgtacggcagctatgaaaggcgccgcagtcgcgttggggctgcgattcttgcgatgtagctctttgtaccggccagaaatgttgggacttctgaaagaatttaaatactattacttaggaataatatataaggttaagatatatatagattataagaatatttaatattttactataatctagtaacttaatactttttataaacatatactaaaaaataaataactttaagatatataattgttatttatataaatacaagtataaaaagggattattatggaattttagctgtatattaaagaactttttataaacatatactaaaaaataaataactttaagatatataattgttatttatataaatacaagtataaaaagagattattatggaattttagctgtatattaaagagaaagtaaaataaagatgatataataaggctattctagtaataatatccgggcaaagggagcggctattcctattggtcgaatcgcagaaccttctgatgtagctaatgctgccttgtttcttgctgaccccgctagttcgcttatcagcggcgcggaaattcgtgttgatggtgcccacagcgtttagtaactgtaaagatgacaggaatacccgctgaacttaagcatatcaataagcggaggaaaagaaaccaacagggattgccctagtaacggcgagtgactattaaattaattttatttaatttaattttctatctaataaactttctaataattctattctatttaattctcttctatttaataatactaattaaaatagatataaattattgttttagagggtgggaagcgctgtaagtcgaggacagtggctagatacagggagggccggtctactgagcgggagctacaggcggtgagatagcctgtggggtgcaggttatgtgaggtgcaggttatgtaaagtgtaggtcatgtgaggttgaatatgaggaacttcgccgatacatagtgactcaccgagccaatcttcttcgggcggatcggttgtgcgaccatcaaggtctcctcgatcgaagagacccctggtttaagtaccaagtctttactccgatggatgatcgatcagccagatcttcatttatatcggtcgcgcggtttggtggccgtgaggcgatttttttgatttcccatacaaatgaattttgcggaaaatcaaaactggcccgggaactgaccgtggcgtgcaagagtgtgaaggggtggggcgaatgcggagggtgcggtccgcatggcatgggaaagatcgtcccgcagcaaaatccctgtctctgttctttcgttcctcagcatgttgcccttcgggccgagagtatcgtgtctatgtattttgattccacgccacagctatccattcgcttcgcgcagtgggctgtcggaggaacagcaggggggcttttggccggccagaaagcggagtcggcacttctcaacgtacatggcggattattataatatttaaaccagtgaagagttgtccttttgtgaaaaatcacgcaggtctacaaagaggaaacgcaaggatgaaccggatactggaggtatggtaacccaggtgcttgttggaagagagtctaacgtatcaggaagcgagcggctcaccccatggaagaaatttgaatgaaccatcgccggcgcaaggccatgcgattcgagaagttatcatgaatcaccagagagccccgacgggcattggtaaataaatatttattttaattagtattattagatagaagagaattaaatagaatagaattattagaaagtttattagatagaaaacgcaagctgatgacttgcgcttactagggattcctcgttgaagagcaataattgcaatgctctatccccagcacgacggcgtttaacaagattacccaggcctttcggccaagggagtactcgctggctccgtcagtgtagcgcgcgtgcggcccagaagccactagtaaagtgtcttggagggcacctgaggtctgaatgatggatgggaggctacaagcccagttaacataagatgaatagctaaactcatatccgtgcaggacttacatatccatttccccttgaagatagatactaaattcatcttgcaaacaactcagggccggaaagctctccaaactcggtcatttagaggaagtaaaagtcgtaacaaggtctccgttggtgaaccagctgagggatcatgcctccctgccttagcacatcgagtactgttctataatcagttgacgtgaataaccatgttcttcacctgctttttttttgtttcctttctttcttttcgttattgcttcgaacagaaggagcctttgccttaccagattggcaaattgccgcctccctgccttagcacatcgagtactgttctataatcagttgacgtgaataaccatgttcttcacctgcttttttttatttcctttgattcttttcgttattgcttcgaacagaaggagcctttgccttaccagattggcaaattgccattgcatcgaacatggcacccttgaaaatccgcgggaaggaataattctcacgccaggtcgtactcataaccgcagcaggtctccaaggtgaacagccgctggttgatagaacaatgtagataagggaagtcggcaaaatagatccgtaacttcgggataaggattggctctaagggttggttgcgacggatggtgagcaggttatcctcgctcagccccgtcgcatccacgatcttccagggcgccttgaaccgacaggccgtccgcctgtacttaatcagcacagcctctttgtgctcgcaaaccagtgacgaggatgaagtgctcgtaactacgaatactagcacaaaatttggtgagggatggtacccatatcgagaaccaaaaactattatataaagtcatgtaaatctaaccagtctgaaaattctcatgcatcaaagaattcttgttttctatctcctttcgctgtgcgaaacggtcctgtaagcagtagagtagccttgttgttacgatctgctgagggtaagccgtccttcgcctcgatttcccagaatactggcgggcgaaatgtgcgttcaaagattcgatgattcactgaattctgcaattcacattacttatcgcatttcgctgcgttcttcatcggcatatctagattggaacaaagcagaagatgaacgtatagaggcccaggtcgctagagagatagaaagcaatccattcgctagtaggagacgaggtgtgcaagatatctggcgaaggatagaggaggatgtcaaggaacaggaaggctacatagctctggaagctgtcgatttaaactcagcccgtaccaaaactatactgccgattgggacacatctgctgttaatcggagcttaacttttcaccgaattccctgtcaagttccgtataatttcgcaaaattcgctgaaaaagggccccacattgcaaccctgttcgtatccacacgaattcccctcttggaaagctgaaggaattatccaagatctaagacctagtctagggtaggctggttatagggtagcctgggtataggttaggttgtctgagaatatcctagattaataatagttagattaattcttatactaaactattatatataatttatactattagtaatagttatatctaattatcctacttatagttaatatatatttataaatattattctagagtttagtttaattattctatttaactattactttatagatagtaagctattaaaagcttatattttatatctatttgttcatagcgacgtcgctttttgatccttcgatgtcggctcttcctatcataccgaagcagaattcggtaagcgttggagtgttcacccactaatagggaacgtgagctgggtttagaccgtcgtgagacaggttagttttaccctactgatgacctcgtgttgttacgatctgctgagggtaagccgtccttcgcctcgatttccccaatacaggcggccctggtggctggctgcgtcgggggtttgggagatggattacaaggacgccagagttctggcgcccggtctgtctctcgggaagcggctgcagggtagcctgggccagtccggacgcctcactgagccattcaatcggtagtagcgacgggcggtgtgtacaaagggcagggacgtaagcaacgcaagctgatgacttgcgcttactagggattcctcgttgaagagcaataattgcaatgctctatccccagcacgatatttgacgatcgatttgcacgtcagaaccgctgcgagcctccaccagagtttcctctggcttcaccctatacaggcatcgttcaccttctttcgggtccggccccgtacacaccgcccgtcgctactaccgattgaatggctcagtgaggcgtccggactggcccagagaggagggaaaccaccacgcagggccggaaagctctccaaactcggtcatttagaggaagtaaaagtcgtaacaaggtctccgttggtgaaccagcggctagtgccgagaggctgctggtaagacttggtaaaggaaccctggatcggcgaaggacaattgatgaatacaaagaagagatagaggctctccactctcaccgattctctacattttctataatgcagatcttattgaaagctgcagcctggtagaagataccacagccactgggtttatcgacgacgtggctatcctcacatggggagatacgacgacggaaacatgtagcaagcttcagcacagatactggataggggtccggccttgtagccggcttttgcgatgctgggctatgatattcgagatatcctttgtaatgacacactgaaaatcaaaatcaaggggacttttacccttttgttctactggagatttctgttctccatgagccccccttagtacacctgcgttatggtttaacagatgtgccgccccagccaaactccccacctgacaatgtcttcaacccgggtcggccccacactgaaaatcaaaatcaaggggacttttacccttttgttctactggagatttctgttctccatgagccccccttagcacacctgcgttatggtttaacagatgtgccgccccagccaaactccccacctgacaatgtcttcaacccgggtcggcccataatctatatagagatagctcttatttaattaattaagtttttatttattttattctattaattttaattagagtttagatttagagttaattcccgccaatttcccttataaacccggtgttgcaatccctctgaagcccgaagttgatcaccgatatcaacaccacccatgttgtctccaacctctatgctggctgcaatggatcaatttacaaagggggcaactgcaatgatgcaccaggtggctcttttacatgctgaggtccgggatcttcgtacggcaaatgaggtactaagcaagcgccgaagagctaaaaaaagccgcgtacggcttagtggcccgggaagcagctttagcgggatttagagtagtttttagtcggtagacttatgagagaaattagtataattttttggtctctctcataaaaataagattcttttgcgctatattttgcactatattaggtccctctagcactaaaactcactgactcttttaaataattattaatataattatctatatatctattattactagctctataatacttatatattaatagtaatttatattatatagcccctggctgccgtagaacttcttcttgtgcacttccagcccactttctgatgctcctttccgtagtaccccctagtttgacatcgcccgcatatattgattccaactaatttcccgcaaacttgaaagggaaaaatctttattcaccgcccttttagccattgaatgatcccaatgtgaaacattttggggttaatcgcagtccgctcttcgcagctgtgtatacgaagaactcggagatactcttggagctgctgaggaatggcgcggaccgaaacgccgccccgatcttgcagtatgcctgctccattgggacgtttgacgctgtccaacagctcttggacagagggtgagagccccgtacggttggatgcctagcctctgtgaaactccttcgacgagtcgagtagtttgggaatgctgcgctaaatgggaggtatacgtcttctaaagctaaataccggccagagaccgatagcgcacaagtagagtgatcgaaagatgggaccgaagtggggaaaggttccatgtgaacagcggttggacgtgggttagtcgatcctaagccatagggaagttccgtgtcaaaggcgcactttgcgccgtgtggcgaaagggaagccggtcaatattccggcacctggatgtgggttttgcgcggcacctcgagaccggatttactagggtatgcccagccagcattatgaaccacaatcgagggtgcttctccaaaacgtgcaatagatgtttccagctagaaagaacccattagttggaaacatagagtgagacgctgcaatgaatacacttacagctctcttccattttcagggctagtacattcggttggtgagttgttacacagtccttagcggattccgacttccatggccaccgtccacctgtctggatgtactaacaccttttgtggtgtctgatgagcgtctactctggcaccttaacctcgcgttcggttcatcccgaagggcgaaaaggattgttaaggtttgggggggagataaaccgcaggcaagcctacgatggctggatgaattatctctagtatcgatggttacttcccttaattggaatggaatatattgctcaagaaaccgctaaactttgtaatagtgctccgaaacggccatgcaccaccacccacaaaatcaagaaagagctctcaatctgtcaatcctcattgtgtctggacctggtgagtttcgggtataggttagatcgtctgagaatatcctaggatttttcccggattttctagacccttatctgggctagataagcccaataacctaataatagctctgctggtggcccggacccctgagggttcctagcatcgtttctaccctgagggcgaggtatgggtgagacgcttgagcgccatccattttcagggctagtacattcggttggtgacgatgccaggtgacaccgctagtggacgaagttccaacctcaaattgtacactgtgttcgcgttattgaagagaatatctttgactatctgagtagcctgagcccatgtcaggtccccgttgcagacatagtccgagagcaccgcctgcaaagcgtttcaaatgcctggtgcaagaattaggcaagacttatttgtacacgccacctttattgcgaggaggataggctatatcattttagacctctgtgggttgttgccaattgtacttctaatgggtcctggtcgcgcgtgatccgtcgggagcatgcttttccccataccccatatacgaccttaataaagaaaccacaaccactacattcctcaccggttcaacagacctgttattgcctcaaacttccatcggcttgagccgatagtccctctaagaagccagcgtactgccaaagcaatccgggcaaggagcctgagaaacggctactacatccaaggaaggcagcaggcgcgcaaattacccaatcccgactcggggaggtagtaaggagcctgagaaacggctactacatccaaggaaggcagcaggcgcgcaaattacccaatcccgactcggggaggtagggacaataaatactgatacagggttcttttggatcttgtaattggaatgagtacaatttaaatcccttaacgaggaacaattctgttatatcggggttggggggcctttctcctttctattatatcggggttggggggtatttctcctttccgttatatcggggtgcttaggatcgactaacccacgtccaaccgctgttcacatggaacctttccccacttcggtccttcaagttctcattgaagcttaggatcgactaacccacgtccaaccgctgttcacatggaacctttccccacttcggtccttcaagttctcattgacgtatttgctactaccaccaagatctgcactagaggccgttcaacccgggctcacgccctaggcttcgtcactgacctccagtagaacaaaagggtaaaagtccccttgattttgattttcagtgtgaatacaaaccatgaaagtgtggcctatcgatcctttagttttgcagacgacttagctgtgcgaaacggtcctgtaagcagtagagtagccttgttgttacgatctgctgagggtaagcagtggaaactgcccctgccgagccatccaccactcaattggatcctcggtttcctgtggctccaaccgcagataccgctcgagctcgctacccatcgccggagccttcgctgtcctgcttttgacccactgcttaaacacactagccttgttgttacgatctgctgagggtaagccgtccttcgcctcgatttccccaatacaggcggccctggtggctggctgcgagccttgttgttacgatctgctgagggtaagccgtccttcgcctcgatttccccaatacaggcggccctggtggctggcggcgtagggggtttgggagatggattacaaggacgccctcagttccccagggcatccttccaccacaccaagaccactagggccggtgcggcttgggcgccccaagaggagtgctccgcgcacagcttcaaccatggctaataagacccttaaagtaataataactattatccgaggtaatctaatacagctatttactgactatatttattatatatccctccggtcagttaagggcctacttatagtaataaagctgcttttaatattatagatctagcagctgtatctgcttagtctattactttattatatagcctgcccagtactactgcaggtatttacagaggatagagactagctagaagaaaagctatatcttaagaacagctatctacttatataggcctactataacctaataggccatggaagtcggaatccgctaaggactgtgtaacaactcaccaaccgaatgtactagccctgaaaatggatggcgctcaggccatggaagtcggaatccgctaaggactgtgtaacaactcaccaaccgaatgtactagccctgaaaatggatggcgcgcaagcgtctcacccatacctcgccctcagggtagaaacgatgccctgaggagtaggcggacgtggaggtcagtgacgaagtgattccgctgctccgcgagtatattgtcgacgaaggctgggtcagcgcgcgtgacttcctgattggcctcgctatcacccaggcgtttccaggacccaacttcaactttgctgtgtaccttgatagtctgacggcgattaacggaggccacaactctgctgctggcgctgttcttaggttcctgggtcttttctttcccggtttgatcacggtgcatggaaccatgggtatctggaatgcgattcgggggtggagcggtatgataggaagagccgacatcgaaggatcaaaaagcgacgtcgctatgaacgcttggccgccacaagccagttatacctgtggtaacttttctggcacctctagcttcacacgtcgaaggactaaaggatcgataggccacactttcatggtttgtgaaatcggtttgtccggagctagggtttaatggccggaagagcccagcacctctgctgggtctggtgcgctctcgacgttccagaccaggttgtacgagtcgtgcatggagatattcatgccttgccctgcttttggtgagtgagtgtgcacagcatctccggctaagaagatgcgatcatatttgcaaatgagtcggctactctttggccaacctgcttgacagtcagctttcaagggaaacactggcgtctcccaagtgattgcggcttaccaaactcggtcatttagaggaagtaaaagtcgtaacaaggtctccgttggtgaaccagcggagggatcattaccgagtgtacaactcccaaacccatgtgaacatacctactgttgcttcggcgggattgccccgggcgcctcgtgtgccccggatcactgtgatgcccttagatgttctgggccgcacgcgcgctacactgacggagccagcgagtactcccttggccgaaaggccggggtaatcttgttaaactccgtcgtgctggggatagagcattgcaattattgctcttcaacgaggactccctagtaagcgcaagtcatcagcttgcgttgattacgtccctgccctttgtacacaccgcccgtcgctactaccgatatctcaaatccctttaccagcatgatcttccttcagtcattttgacggaccggtggctggcagcgatgaatgcttcagccacctggttccccctctctaagtcactgctttgcctctggcacgtcaacaaggcagtcttacagcattgccgacctgtcttcatgctaggcggtggagaccagccagaaaaggcatgggatgaattctatgcatcctggcactcgattgtagcctctccaactgaagcagtatttcaggagcgcctgactagcttcgagtgcaaatacgccaagaagtacacagaggccgttgggtatatcaagacagtctggcttgatccatataaggagatggtcgtcaaagcatgggtagataaatacttgcatttcggcaacattgctacctcaaggcaggtagattatagggccatggagccgtaggggatccttgaaaaagctggaggaagaaaggaagaccctcttgctagaacaatttcatcctcattggtacttgaagcggcatgtagatcaaccacggcctatgttggagcctagagcagcctcgagccagcataacgagagacgcgaccagccggcaaaaagtacgaggcgagagcctagtgcatttgaggcagttgaggccgcggtacagccgagggcacagcctacgtgcagcagatgccactcgttaggacataagatgacctggaaagcatgccctcagcggtacgaagagcttttgcaatcgtcagtagcatcatcatcatcggcggcagcacccgagcaggcactggaagcacctatagtaccgccatcgggatcgccagagcatgcaggatcaggtggagatggtcccggttgcattgtcgttaatgtcggtggcatgagtagcagagcgccagcagtgtcgctagcagcgccatcaacacaggcaggggcggggccttcattaagatatgatgacccccgggctatctatcagagatatgttgtcgctcgagacacatggtacaaggcccaactcagtggaagtgttaaaaccaatcaagaatataggaaggttgttttcccttagacccagaagtagccattttaacttctataggtctctaagctatagctttagtaaaggcttaatatagcttatttagaggttcagtaaacactccttattagatctctttataagaggtctagggtaattagaataatagagtaaaattctccttaaattctagtttttaaatatattttttatagatttttagggcttaaaataagccttatagagaataaagaagctagtagcttcaaaagttaatttttaacctgaaatagcgctgtagcctttagcagctttagggccttaggagcctggagcttagcggtcaattgacctaacgttcaaggggctagcagccggctttagcggtctgcagctgtgtgcggcggttgctctagcagtgctaagagcgctgtaactcagtgagtttcagcgttaaacaggatcttctttagtgggctagtagccaattagaagggtttgtttagtggacctagcggtcgaaaggagccaattacagcgggttgccaagaggggtcaagagcctaagcaggggcctaagcagcctataggaagaggctgtttagtgggttcaaaagcctaaaatagcagcctaacaggggctttatagtggagtcttcagtggactgaccactaataaataggtgcacgttggagcctaacaggggtcttagccagtaaaaatacaggctttccagcgggaattagccggatatagcagtaagagcgctgtaagttagtgagccgggctcataacctgattttgtgggtggtggtgcatggccgttcttagttggtggagtgatttgtctgcttaattgcgataacgaacgagaccgtaacctgctaactagcccgtattgctttggcagtacgctggcttcttagagggactatcggctcaaggcgatggaagtttgaggcaataacaggtctgtgatgcccttagatgttctgggccgcacgcgcgctacactgacggagccgttctattttgttggtttctaggaccgccgtaatgattaatagggacagtcgggggcatcagtattcaattgtcagaggggaaattcttggatttattgaagactaactactgcgaaagcatttgccaaggatgttttcattaatcaggaccgaaagttaggggatcgaagacgatcagataccgtcgtagtcttaaccataaactatgccgactagggatcggacgatgagaattaataataatagaaactcttataatatatctatttagattagtattactattattattttattattaaattagantattttaatctatttatagatatttttagaatattcttttactctagttatcttaaataatctattatatagtactataccctaagtcacacacatcataacaaaaacaataacaaaagcttcaattcgtgttttacgagcaaaatggctatatattcagaatcagaaattaattctgcgattaatgatatacttgccggcttatctgtacgcgttgctgcaaagaaatgggcaattcctcgtacaacgcttagacgacgattggaagatggcttcacacgagcataagcgtacgaacaccaacaacgcctctcgaaggcggaagaagagagagtcaggagatggatcgtatcttaagaattgctaggatacgcacctacgcatcgacagcttcgatatatcgcttcccagatccttcaaggtcggaaggatctcgagcctctcggcaggtcctgggtcaaccagtttctcagccgtcaggagggcctaggagtcaagattggaaagcgaatagcgtcagctaggcttaatggagccaatcctgagaatattaataggttctttaataactatgactcggtctcttggatcaaaccggagaacacgtggaacgctgacgaggctggtattatggagggatatggtctcaacagcctcgttatcggctctgacgaaggaagccgtaagtatacagttctcaaagggaaccaagagagggcttgggtcacgctcgttgaggctatttccgctgttggagagacaagcctagctaagatatttctaaagctagcctataggtagacctaaataagatctataaaatgtattagtttaaatggtttagtattaatagaggaggaannntcttctaagttatagtaggaagaggtaaagagagattaggggaaaagggttatttattcaattaaccccacttttaaataaagatctattataagaatattatttttagatataaaataataaaataagtatagaaaaggtttaatttcttattttattatcttagttaataagtaaaaataattagaagttataaagtttaaaaaagtggcccacatagtggtatggcccacatggtggtggatcacgttaaataaagtttattattcttctttaatataaatattatagagtattctatagataaagttaatagctatatatagccttttattaatatattattaatatatttatagagtatttataactagagttctataaggttataaagtttataaaaagctagttcttctctattaataataaagattttataattctactagttatatttaaataagctagttttaagggttttcttaaatagtttattataaattctatattcttctaagatattctttagctgtttttcttctgcttattttatttatataggtttattttaaatattattttccttctactattaattatatttaattttatattcttattattatttctttattagttatttctaattaattagtattaaatctatatttaaaagctattcttatttttatatttaatctaaaatttatattatttatcttagtttctattataataagtttcttatatttctagattataatactattaaagctataattactatatctacttattattataaattattattattttttataataatacttttaaatattaaaaaataaatatattttcctaatatttaataaaattttaatttctattaattctaatttaaatacttaaaagagttctactactctatatagctagtatattaattaattagtagatttatatcttatagctatagtagctctagtataatattatatcctcctagtagtattaagttatagataatattaaatttctttccttagattttaattataaaataattaatctctaaattaataatcctattattatatttaaattttaaatcttctatattagctactatatagatttcttttttctttttttttagtaagtagagttagttaattactactagtaaaatataattttcctatactttatagttaataaatactataagctaatttctcttaatctctatttctataaaaatatatatagaacttctactttctattatttctaagatcttttaatctattattaatattatactatactatagttctattatagatagtttaaattattttttatctaattaatttattctttaaatatattatacttattattatattttaatatttattttaaaagttcttctagagtcttagatatatctatatattctagaatatattattaaaacttctttaattatttactaagtttattttactctttaaaagatatagtttcttcttaagagtaatctatagtctatttttatttatctatagaggtaatttccagttttttattagattccttatctttagttaataatattattatagcttattcctaatattagtattatatttctttctaagcttaatattatttaaatatttatttagtaaagtttttattattatctctatttcttactagattaagtactatctatttagtatatagataatttaaatacttctagttgttgattttagagaggttatagcctctataaattagtggggttttggctgctactagcggttataaccactaactgctagcgatcttagccactggctattagtgatcaaattagctgttaaagaccgctattagcggtcccagccactagccgttagcgatcgcagccactagctgctagcgatcgtaaccactagcttctagcgattgcggccactggccacaaccgctaataaccccctgctaacgctagccaatagcggttgagatcgctatctcttagcgataacaatcactagccaatagcggctgcagccactgtgggtcaaagcctagctaagatatttctaaagctagcctataggtagacctaaataagatctataaaatgtattagtttaaatggtttagtattaatagaggaggaannntcttctaagttatagtaggaagaggtaaagagagattaggggaaaagggttatttattcaattaaccccacttttaaataaagatctattataagaatattatttttagatataaaataataaaataagtatagaaaaggtttaatttcttcttttattatcttggttaataagtaaaaataattagaagttataaagtttaaaaaagtggcccacatggtggtatggcccacatggtggtggatcacgttagagattttttattaaatctttagaatataagataagaaatataaaatagagtataagattaatctatttatttaaactagattagtattagtttttagtattaaatatctttagcttttagctagaactaaatagaactataaatatactatattttactattttaactaatttaagaaaaaagtttagaaaaaactctataaggaaaataaggtagtaagtatttataactatataactatagctataaaaattaataactagtaatattaatagtaaatatataaatagtaaataaactattatactaatactagtagattataataataataaactatagtctttagaatatatataaattctataaagctagaagctatagaaaaatataaatattataattataataagattaaatatatcttattataatatctaaagctaaaaaaataaagaaattagaaacctattaaaaaaagtaagaaataattagaagtaattagaaaaactaaaactaagacttttaaaatagttagaaaaactatttagaaaataaactctataattactatagtttctatatttttcagaatacctactactatttttattaaaatattagaactagaataatattagaattagagtatattataggaaagataataataaatcttataaatcttttagaattttaaatagaagtataaataagaaaaaaatattctaaaacttagatcttttactagatataagtatatattttattatattaataatcttatctagaaaactaataaaaagtaagaatagtatatacttattagagataaaattaaagctaaatataataagttatatatctactattagaagaaaatataagagtaaaatctagatagaaacttaggattaatagtttatagaaaaaatactattaatactatttaatattaagataataaatataatatactaatttatataaaaactataggaatatagaattattctatagaattataaataatctattataatatttaatattagatatactaaaaagctaaaataaaaaataactttttcttatattctaataaaagaatatttattaaacttaaagaagtttaaataatatattttatatactaataatatagaatagaactatatactatctttaaggaagatttagaaaaatactctattaaatatatatataaagaactattagttattattattatttaccctaggtgctaggtctagctagtctctagtccctctatctaatctctaacaagggaaaaccttttgtacaggataaaaaccttgttctgctcgtttccttcgtggcttcgtctaggtaccgatacggctcctagtttcccgccttcctttgtttgtccgctgtgtttctatcttggctctcacctgccagttggtgtagacggggtggtctttgactcgtgtccgtatcggacgcgatttggctccgcctcgaggtcgacttcttatagccggccttgaataaataatttggggggtatttttccggttatctgattggttggccttatttcttttgattttgatttcctctttgggagttatctgggcaggatttctttgttgtctttggttttctgtttgtccgatccgttccccgtacgtatttggtacggctccagttcggttccttgactttgtattcttctccgtttgactttttcggtcatggggtggggaggtgtggttactgtactggttcgggtcggttgcgatacggattccttatgtgtttgccatcgctcgtgtaactttttggtgtccggtacgttttcctcgcgggttctcagatcactcggatcactcgcgccctctcccacacctataaatacctcccttccccccgacttcttttcctcctttcttctctttcttccttgtgcaaccagataatcaggtaagttcccccctttctccgcatcgactccgatacgaatgagatccggagcagatcctactccgcatcgtttccgcgcttcttccgtcctgtctcgctctctgccctctgccgccatgcagacccagtccgttccctcctcctccgcctcgtgctggtcggtagtcctgcggcaattcaacgaagtatcttccgcggcggtgctctcacgagggtgactcgcagccgtctcctgctgaatctgcatctgcacgctctcatccccctccgccccggaccgtgtgcgttttctcctcaatgtcccagccacagccttgaccgggccatgcaaccatcgaaagtcatgcacgacagttgcaatgcccccaagaaacataagcagtgggaaataccacaacgcattgtacatcatgccagcagcagcgcccaggaagacgacgatacgcgtcattttgtcggtaatggccttttcggacagctggacggctgccaggacgatgatgccaacggtggcggcgttgaggccggagagcaaggcgtaaacggggcgagggagggagtcgccaatattggaaacgccgatagagaggccgtacatgcccagggcgccagggaggctgttcaacaagtcagttctacaccgagatgttgaggatgagagacgttacctccagatgacgaatccgacaacggcggggatgaagccatcatgcaggagattgatgcagtaatgcatcttggtgctgccggggccggaaaaggcctgacagatgctgaagagctcttgatactacagcaccgttatcatcagcagagagtttcgcggcagtttcacgagtacataccacctgctcatcaatccatgagagcttggcgacaaacttgtcgtgaaactaccagccagcatgttagccatcaccattgtcggccagataatgtctcatcggccacccgcatggattgatccttccaacgcggcatccacggaagaggtgaagatggatcggctacggggattacggttttggagattctgggcagtcgacgggaccatgaactcacaatcttgaagtgggccggtgggcctccaaaggacgtgaatcccagctaccaattctcccgaataatgttctggaggccttttgcgagaccgctgggtcggaatcgcgaccaaggtgtcttgatggtcattgtcgcgtgatgtcgaggagcctccagtacggtcactaagtcgttaccctaagcccactgcgatgaatatcctcaaatcaattgaccctgctctcgttattccacacacaatgaatgcgctgcttgaagcaccctgtaggtacgaaagaggtgaagacgcaaggtttgttctcacaaaagaggcgaagaggatatatgtacctggctctggctgatcgccccggtttcattaaacagccccctagaaaaggctcttgctatctgcgacgccagcgaatgaaggagaagtttcctccacgtgctgaagtgctagatccctgctatcatatgctttcccccggtgagccggatgtagttaagtgccatcgtgcaaacagccggcatgcacgctaaaggcaaaggctgacgtagaaaatataaagtagtaccgctaaaaaaaaatgagcctcgcccgcaatgctcgcaagaagactgagggtagttattattatttatatagtactaaatgtacgaagtccaagtaaaggagagatactcgactttgaggctgaagattttgtttagtcatcgtcacaggttgtggcgagtgagtatggcgcgaactgtggcgcgaactgtggcgctacggggcccgccagcagacctttcggaacgagactttccggactgtggctgtagagacaggagaccggtccccctatagggaccgccaacgccttatcggaaagagttaagagccaagtcgtcattgtgttactgaaagcgcacttgtaagtaatgtagggatttccccaatggctcatttcttgtcaaggactcgctacatgcatcactctcagcatgctgtagaaggccactcatatataggaagagagttcaactgaggagcgagcttctggcccacagcgatgggtaactcggcttgcggaggttctacatcctgactccattgataggcagccttgagtcttgaaacgccaaaagagaattcactagcttgacagaagacgtgatactgagcttggaaggatacacggcggcaataagctcggaagcgatcttgacatactctcgaaggtcctcctcggcggatggagtatctaagtccgatactcgcaatgggatgagagcaagtttgacctcgacaggattaacttgattctttgtcataataaaacgttggagcgtttcgatgccgacactctcgaaataagccagagtgtttcccaacgcagcagaatgatcgtgagcttttccatatgtctggcctggggcaggggtagcaggaaataaactgacgacgtctttcacaacggctgccatattatcgagaccctcctcctcgagggcagtgtagttagtgcagacttggtatgcatcttggatcttggcaaagttctccttatccaccttggactgtgccttagtcaagttgaccgtgatgtagccagcatcttcactcgtaggatatgggttctcgaggattcgtcttgcagctagagagacctgttcaccggcaagcccgaggcagttaagagatgtttcacctgcaggaattccatgacgagcggcaaagctaccacaagcaactatgtaatcattagggttatatcatggcacaaggctgagtgtatgacttacactgcccaaagtcttcgcagggatcaatctgtgtgtagttcagagccagatttccgaggatatcggaagcaatgaagatgcaagatggagttgtgcagaggttggtatccgccgcgctggaggccatgacgatcgacagcgacgcgactgcgcaagctcaagaaggcttaataagagaaaagagaacactcgtttataaagagggaaaagtctctgtttctaggatgttgaaggctaaagctgagatggtcaaagttgcaaagcgaggcatctcctcttatataactgctagtcactataaccctaatccttaattattctgcgcatatttcgtactaacattcaggattgttagtcctcctttttagaaaaaatcaaacaagaaaaatatcagtcaaaatacatcctaatggggttagactgagacccgctagtaatacccctattgttacttctcagtttccgacaattctgacagagaacttgtcagctcgcttacacccagcaggtaatagcaagatcctcaaatcgctacacagactgattaatccatacaaggttagttcctatcctaagctagatctgtctagaccgagaaggtcacactaccttcatcagaatagaatctaaataggcattagctaacttgaggattaaaaggctggtatgcttattctataagaaggatccttagttattatttctagataagaagattaatacgccatccctacttctgttttatatcactggtttcttcccagccttaccggtataccatatagctataatccctgtaagatatataggtttatctgtctgatacttaaagtgatttatactcgcttaaacagactagtaagttatatactaaactttctgacaattataatatgtggggtagtatggatatacctttaatttggggctttttaattaaccagaaatatacatttgtatcccttgctgtataactttcagccgcactacggttataggcagtcataccaaattagcgcgcagttatttttaaaggcctttaggcttggagttacgtcttgataaagtatataagaatataaacaaaccgcattaagtgaattctttattattccctagcatcttcacttctcccttctcaaagacactcgcaatatcagctattccaccgatcactatgttatactactaaggaaatggatactctataccgcaacagcagtatcagttctatccccctcctagtaccttgctgcggcctcaataacagatacctgctgcccagccccatactggcgtagaccagtactcgctagtacagagtgacagaggtatctttgcaggtggtaactataatatcgcccatcgtgatactaacgctgttcttaatatcaatcttcagcagggcgctactgtatgtttaaagtcaggtgtaataatccacatatcaggtactatataactatcaggcagggtcaagttctctatacagaagctctttacgggcggcgaaatatctgagtcaatatatactgggctaggttatatcgccctcggtccaactctattcggagatattattactttatatattaataaccgttagtcctggaatatcagtaaggatacttttctcgcctgtatatccgaggtatctaagaaaagtaagtctcaggggattagaaaggctatattctcgggcgaggatctcttcgtctattgtattaagggccagggtataatatggttaacgagctttagtaccgttgatcgactagatataagacttctaaattccttttcttatttcaactgcttctcaccctatactactaatcccttaccgatagctctaatctggcgagcagtatattatagataacagctatcttatagtatagagctgtacttataagattaaaaaggcaggtagcaggactataagtagtattaagacgggcgagggtctggtctgctgttttaccggccctggctcggtttatatgcagactcgaaatatagataagttccaggcctttatccaggccagtattactacagcctaggttaatgtaatctatatatatacttagctataggcgcaatttgtagcagttatacctggtcagtgcggttagctagatatttatccgtagcgccttactttgcctatactatttgatatttaaccagctgcccccgaacttcttatttttccttattaacctctttttacatctatctccctagcttctatcgatcgcaattccaaatgttaatgtgaatatactcttagacccctatgaagccagatatcccccttatgtatagcccctttctgcctatagtttccctctagtgctcagctttgtcttattggatgaatcctgaattatctgaaaatccgggtttattctataaatctgatattctttactgctaattaactagctcttattaagttattcctaaagattccgatgtcttacaaattggtctagttcctgcttatacagtgcggtatacttcctatattacagtaagatgtaagctactgtctctcacccttctctgctgtagttacatttcgggttgttaaattccagtactcttggtttgaaaagaaaatcgctaatgttagtcttctctgtctggagataaattgagataatactgtgcctcttgctaaagtacttgtatagtagtagtgctttagctgttagctctagtgtatatctagagattatccgactcctggtttcttattattattataactctgtgcgactacccctttagtaaagatataaaataggtctttattacttatatttacctcggtttttatcctcctaagtaatctagatagctaaagagatatttgtagttcgcaggcgtatactattaatagaatattatttcccatataggtactcttaccttgttcggtggtatatatatagctgcagccccgatataactattaataccgctctcgtctgtatatttatatagtggttagctcaatgttgatactatactagtactttggctttactgtctcaactcgttcttatataattgttttcgggtctatctactatagtaggacacccgcgggatcattgcttctattctattatattgaatccttgtatatcctgtatcgccttctgtatcgcttctgtacgggcttatctttgccttcctctctcctcggtcttctaagctatactatagttcttatcctatagtcttttcgcctgaaaccaggtcttcctaagtactcagtataatacttctaattatataatcggtggggagaagatatatttcgatgtttaaagtcggtattcatatagctgtgaacacataagctactctgcccgccagtatatatatactttatattgctctgatgtcttattggtatataatatactttgtattctttattttgcatctgatcagattagtttctaacctcctatataggttcaaggaagcagtatatgtatttctgctatataggttaagggatatacaactgatacatataccagataagcggatcagttaagttagcaaaataaaaatccctcaatctatattatctctctttagttaattacttcttaataactagctatattaaaatctattaagaagtcttagaccctccttaaattttatacctatcagaacgatcctaaattaagcctctgatacgctataaagctctaccaggctttgaatactactctccaccgccgtcaggatgtattactaccagtcgcgatgctatctcaatatatcgccattgtccatagtttgctggagcaaggaattagtacgttaaataaatttctttatttggtagtcacaccagtcccagaaatcagctgtaaggccggtacccccgttatctttcggcttcaagcttgagagaagatccttcctagggctcgggtgctatctgccccatgggacgctataccggccaccgtcttcaagcttaatatctgtactaagcctggcccagagctctgaataagtgcctcgtttgggtgggtgcaagaggattctgacaggtgtcttgataatccaaggaatatgatcctatatattagtcaccaggttgcctggattttgagtaatgaatagaattctatccgctcggatacagcgattaaattcggacgcgaggaactaattcccagtcttcgaaattgcgtagttatacgacgggtcggcagattaattgctagggactagctcagacagtggtatacctcccagcggggccgctatatctaccatagctgaggctataaagataacttgtatcgaaggtccaggagagaaactagccgtttgttttaggataggaagtaagagcttagtgaggagaaatggccctaggtaattgattcctatgtaaggcttatacccttgaacggtaagctcatcagatggtgtgtagctaatgcccgcgttgttccataggacatcgaggcaactctcccgtaccaggaaggtagaggcacaggctgccaccgaattaagattattgagatcaagactgagggtttgtagatcgccggtactttctgggtgagcagcttgtatagcttgaatagtccttgctgctttggtggtagatcggcagggaagataaactgtgcctcctttagcataaagtatatcgaccagcgccaggctgaccctactagttccaccagtcacgagaaagactttaccctttaatgagggtatgctttcctcggtgtaggtaggcttttataggaatagctgagtgaaagtagctcttataatgatatcttaaagataatagaaatcttggaagttgctaagtggaagaaaatagtgctggagactgggtatactttaatatttcccttaaatagaacgagggcgtagttgatacttatatgtgtgaatatactttagtttattaatctttctgtagatattccctatgaacagtctgacgttcaggattattaatctccttgtcagaaaaaaaacggctaagaaaaacaatggtcagaatacatctactaaaacccccttttgtaaatatgcagcagaatgacaagaataacgacttatcggataactacttatactcctggaccaatcattctagtagagctagtaacagtggtttctctccgcgttgagatctccagaaattagttgtttagaggatcccgttgtctatcaaaaaccactatcttttcgcaaattctttactaacttcccatcccattagctcccaaggcacggctccccagattctgagatttccattccgcatctcaagtataaactcatctttattgataatggaaagggacttgaggagccggtctcttaacgaagcccagggtagcatatctaagtaagatcggtgtggaacgcttctttgcagctgggtcggcgttatagataaaggcagattttgagttgaagcccttatatggaagccgggccttatctggcagtcaaggtcgaggcgctgggcgataacggccagagctgcacaagcagttatgtcagccagtataataaaatgactgtccactatgggcccctggcacgagaactgggcacaaaatgggctaagcttggatatgtctgctatagccatagctgatacatccggggatgactgctggtgaccgggacttagatcagcatctcctcgagatggggcacttgcgtccatgttgtcaggttcacactgtgctatggcttgacctcgttttccagtaagccgcgcgcctgtgattcatcatcagctaaatgatttcttccattgcgagcgcgatatcattgtacatacgccttgcccgttgtgcaagccggttttggatccgcttgcgctgggcggggtctggtacggtggtccaatcatccgcgatggtcttcataaatggctcccagttggattccatcttaagggagtacacaggtttgaagaaaaattcagtgaatgttgaggtacaagagcttgacaagtgtggagggcggttaatgggttcgctctacggggtggtggattgatgaggcctcctattattgcttgtccatttctgacaatttctgacactgggacttgtcagcttgcaaaacgaagtgggcgatagcaataatatgatcgagtcaccattcggactaatctgtacaaggctagccctacaagtcttatcccgatccaaccctagctttatttgaatgtggaggctggggctactcaatcatcgtcctgatttgtcgaccggtcgaggctatgtatgtcacttaaattaaggagagtggagggcttaggtagcgctacttttgccagcaaatcgctgaacagtctccaattgagaacctatgggctcttatgaaggctgagatctatctacttcatccagagcttgagtttgctccagataatgctgatacacttaaccggctagtagcagccgcaaaggaagcttggcatgctattgaagatcatatacaccaaagcctgattaactcactgcctcgcagagtagctgcaatcatagaagcccacggctggtatacaaaatactaggaataaaagcagcaatctgattgtggatacatctaacctgatctggctcatcagcgcgttgtaacatgacgagggtgggcaaatactaaatgacccccactgtagctgggctcgtatctatgtgtaacaaaatcaacaagtcagctaccgtatcgggattggcctgtccagctcagccgcccctcctgcattcgtgccttattaggtattgagtgacaaaatgattctgcagctttcattgctagaaaaggtggtcaagacaccggccatttcgccaaccatattcacataacacacaactacgccgtcccccatgcgcctcatcaatgtgcgcaactaccatcttgagaccttcttgggctcaaatattccaccctacgcgatcctttctcacacctggggccacaatgaaatcacattcgagcagatgccgctccaggtgccctctgcggtagcagacaccaacccagaggaggacctggaaggcggttacatgaagattatctatgcttgcaagcaggctctgtctgatggcctaaattacgcctgggtagatacgtgctgcatcgacaaatccagcagtgcagagttgacagaggctatcaactccatgtttcagtggtaccatcaggcagcagtttgctacgcctacctgtcggacatcgaaaacgacagtcgtctccacggcatgatgatctcgcatggaatagagagaagcaagtggttcagtcggggttggaccctccaagagcttcttgcgcctatgaagcttcaattcttcatccggggttggaggtatgttggcaccgttgaggagctgcaggatataatcgaagagcgaactgggatagagaggatgtacttgacaaaggacttgtcacctctcatgtgtcgccacgccagcgtcgccacgagaatgagctgggctgcaggccgtcggacgacccggcttgaagaccaagcctactgcctactcggaattttcgatgtcaatatgcccttgctgtatggggagggcgagaaggctttcatccggttacaggaggagatcatgaaatcctcctccgatgagactatccttgcatggaattggatgagtggatcaagaacggttggcaaaagtgttcatggctacctggcaatgtcaccaatgtgcttttacaactgccaagatctgcgtccttggcccagcagtggaggagaggcgaacttctcggtgacgaacaggggccttcaggtcagtctgcccttaattcacaggggtggagataggtacgatgcgattctcaggtgcaataccaagatggacatcgaccgagcagtgactttgcctttggtgaaactggggaccggccacggagggctattgaatcgagttccatacttctcccgttcacaccaagccaccagcataaaatttgttggaaacgatacattgcgttctaccacaatctgcatttcatcccgcccctggtggccccagatcattcacgacgcggaagccatccaaggattctacatccgcaacttaccagcgggatgcttcatcacccatacataccccactgatggttggtcgccggcagataattttgccaccatgaaagaagccaacaacggctacgaaccgcggtacttctttggttcctactacttcgagaacttcgtgattcgtcttgaacatatatccgacagatgggtgtgcaaaattgcaagtgatgcagaaccaacatccctaacgcttaaggagaccctggccaggttaacctttagcgagcacgtcgagctcatggatcgtagaatgactgtttctgcaagattagagcctatactgaatggctttcttatcgttatcgacctgagcgagaggactgagtggatatgggaacttggaggtgtattattagggatattgggtgccggggctaccctcgctgctgtgggatctgtaactaggcccagaaagaaatctagttgagagaaaggagcttgtttttaccagaatgaggacaacaagtgttagaagcttcgagacggaatgattgatgattagaactagactcagatcctgccgatctaaaataattgaaatgcccttagtatgatatatagttgcaaaagacccatcagattttcaagttctaaatccattgagggtaatttctcccagcgcctccagtcctaaatccgtatcttggaatcctatgagtccctgatcgtacaatgattttgctacgggatacacagcccggccaaaattactccgttgagccaaaacaaatgacggggtgatgtcgttgtgcttgaacccgtgcctctcttttctcgggtggaatgcatgtagcagatacgtgcaagaccagtcatgggcccattttggggtccaaccaagacgggaagcaagaccaaatagccgcgtaccttcttcatgcgtatggaagagcaagctcacgtcctcactgtcccagctccccggcgcaaacgcatcctggtggagtatcagcatatcacacccctcttccctacgttctgccacatgcgtaagggcgatgttgctatgcgttgtccactggccatcgtatacccgcgtcatccgttccatccaccgcttcatgacccttccgcccttgattgacatgaatgtcccgctgtttaactcacccgcatgctgccttccagcaacggcactgtagccacgttctcgaagatctttgatatctctgagcgggaagacatccatgtcaatgtaaatccctccgtaatcatagacggcctgtaccctgacaaaatcggacttgtgctcaatattttgaatctcctttccgttctctgcgtgcgttggcaccttgacttcattcacaaccaacacgggaagcgtcaagagcaacgaactccatttcccggaggaaccgctcttagcacgcgcaagagaggcgctgtccgcgttggtgtgtagatatatttcgttcgggttccagtagtaataggcagagtatacgctcaagaaatggctgaactggaactgcaaatcatcagacgaccgagggagaaggtagacatagtgcacaatattgggaattgtgtgtttgcctgtccgctcatcacagctcgacgcgctcttttcttcaagcttgcatgctgaattcagcgccgggggaatcttagaagagcggaaagagatattcggcggctggcggagggataggagtaaccagaaaagaaaaataaccgctactccgacggccaagcgtttcttgacgagcattagggttgacagaccgcaattctcctatcgcattccagtgatcggatatcttacatgacagtccataatgaacatgaaaacggcgagtgtagatgggctggcccagggggaggggcgtgttaaatgagcctccatccaagcacaagcgacactgtactttggcacctgtcacgtgtcattacgagcagtaggtagtcagtagcgcaaaattggaggcctataattagccttgtggcacacactcaggcacttgacctgaatcatcgcatactcgacgtagagctacaatcaatgcatgtacgaatataactcccggtcgggattccagtttaatagaaatgattatgggatattcctattgaaaagactccaaagttctatttccctatttcgcgcgctggccaagtacctacataatatagcaagtttgaccacacaatttttgagagaaatcgactactggcagatcttctgcactagcagtctgtcagccgcaactggctggaattcccagaatacgaattttcgccatttcagcgagtcgcttatccaggatacccttatagcattgtaattccagtgtaacaacggcaaacaccccgtgaagtgaactatgccttttcatcgatcccgttaccacctcaaatgctttgataattggataagatttctaaggcaaagggtcaggaaaagcctcctcgtaattgcccttgagtgattggttcggttgtaagcaaatgcaatgccccggtatactatatacgatgacaacagctctcatcccctgcccagagaagtaacggaacgaagccctcatatgacgtgaagctggagaactggatgccactcctgcagaactgactgaaatagtacccagtttcggactagtttgtggggcgatccttgcagtgaagtaacatcgaaacctgtatgagagccgagactccgaagggaacactggatagagtgacgaataggaggatagctactcacggcagactgaaattgtacctctattgggactaccgtcgatgataaagtcttacatctattgccacgagtgaaaatcctacacctcggcgtgactccgtccatattaacatgtaggttcgacggcatcagccgatcctagctcttcgctatctataaataagagagctttcccaatgttcagaattcaaaaaaatcattctcatccacatccaaatacccaaaaatgtcctcccccaccttcatcacagtagggcgtgccatgccccttgaggcacgtctagctctcaggcaagagctgcttgatgcagatgacaaatttgttcttgagcttcccaaagtcgagttacacgtccacatagaaggaaccttgacgcccgagctgagatgggggcttgcccaaaggaatggccagacactaatgctcgagcgcaccggaaccgtgtacaccagtctggaacagctacgagcgtcatacaccatcatggaacctcggccaggtcatagtattgacaatgccgaagaaagttttactttttttgaggcttactatggtggctttgaggtacttgtgaccgagcaagatttttttgatctggctatgaattactttcgacgagccgcttccatgaacgttcgctactgtgaacctttcttcgaccctcaaggccacacacgccgtggggtttcttgggaaaccatgatggggggcttccgtagagcccaacaggaagcagagaagagctttggtgtacgttaaaagcggactgtcagatttccccacatgctaaacaagagaacagatcaagtcgaagtggattatgtgttttctccgcgacttaccagtggagtctgcaatggagcactaccaagctgttctcccataccgtgatatggtcgtcggtattggtctggattcggacgagactaatcggcccccctctttatttgcagatatcttcgccttggccagacaggctggcttccgcctgacttgtcactgcgacgtgggacaaccaaccacacacgaaaacattcggcaggtggcatcggtccttggaggatccggtgcagagcgcctagaccatggtttgaatgctgcgcaaagccaagagttgattcaactaatcaagaagaacggtgttggcatgaccataacaccgtggggttatctccggcatcaaccagtcgatgagatcttcccgagaatccgaacattatttgacgcgggtattcagattgcgattgggagcgatgacccaccatatatggaggactgttggattatacaccacctgctgcttgccaagaaaatgtgcgcattcactgaccatgacatggcaactttggcgagacgttccgttgacatgtcttgggcatcggagtcggtgcgggcggagattaaggacgagatagagaaggttgtggctaagtacttggattaagaaccccaaatagatggtttttctttccttcgatctcttacaccttagtactcataccaggttatgctagcattatggtacgctcgtatgtgccatttgccacgaaaccaccttggatacgtttctcccaagcaagctccagagtatcagctgcattcctgaaatggcggcatccaacagcttcatacgctagttttaatcgtgaccttatccagtctttctcctgcaattgtctagtctcaagggcaaccccaacttgaaaaataggccataacaaggagtaactccaggagctggctgatggtatgagttttgcgtgatggaggacctggctcgtcaaatttgacatttgaactatgttataacaagttgggaagagttgtgccaggtacgccatgataccaaatcgccaagcttcgaccatgtgcttccgagatccagatagcatttggccggatttccatttcctgagacggtccatcaagtcattaacacgtttccgctcgctctctttcggatgatctcggttggggtgtgatttgtacaacatggtgacatccacaagcatctcgaataggtcgattggacatggaaagacgtcatagctccattctctgccatccacgcttgagtggcgatggagagccgtgctgatttctgtagtcgtaaaattaggagctcgtgaggaagatgttgaactgatgatgtcaagcctatgaagaaccttcagttaagaatgcttgctttgaatcagaacgttctccactgaccatacaagccgctgttcgaaatagtatctgttcacgctctgttcaacgtgtcggccacgtaaaatagcaaccgctgcctgtaagtgtgtctcaaactcgatgcagtcccccgagcacatctggttgcggttagacaactacctaccagtgacatgttcggtcgttacaacttacatcaacctgagctaacataagaatgctggctaaagtggcttggtccgttgctatgcttgagtcattcaacctctccctgaggaaatgcgttgcacggacacgcagatacaagctctttcgctccagttcctcatctgagtttctggctgccatgtgacatgacgctgatgcggcgattgcaaaccgtatagggggcacgctatttatcagcggaagtacgtaacggaacattgggttgtctcctgatccatcaccgaggtagaagatattgctaagatcatcaacatctgtgttgagttaaagttagtaagtctcaagtcaaataggggtgaaaacggcgccttgcaatgatggactagtttcgttatgtcattatcctcagtatgggttgcgccgtccaccgaccaagatgtagaatgaatgccatcagttttcggtatcctcttttcatcgtgttgcactgaatcatggttggcaggtgccgctccagatgatagagtacgccgagctcgggctgaacttcgttttgacgttgtaatcgggctgctgctcacagggatagatcttccagccagcttcccgcgcgcggctactcctggccatctggttacatagccttcacagaccactcctcggcgctcacagctaaggcaggttggaagtgtgcgatcgcactttcggcctcttcggcggcagcctttacacgcggtgccgtgaagtgccttttggctcatctcgataaagccattggccagcacggtgctacgaggtagtctgttaattggcttattcgtcacgggtggtgagttttccgggctgggttgttgaattagggagtcgttgccggtcatgactcattcgaaataattcgaaggcaagactaactccatggagaataagcggggatatgatgcggggagacactccatctcaattcactgtctggctgctccattcttccacgttaaagcaatcgctcctatctcataacggaagtattgccgattctgtgtgtcaatattccccatgtccgactatgttgccagctcaaaacctaaacgcactgctgcaagttgtaaatgcgtgactgatagctagccttagactctcacaactgctcgaataattgattgggttttactttgatgccgattgggtttctccggagccttttctcttgataatgggttcatgaacgaggttcagcctttctcatgggacccatcagactgacagccatgtctatcaattttgccaccacgaacccccctaatgcttctctcgcggcagatggccgggatttcagccatagttgcagggaagacttcgtaacttgtccaattagagaagtccattaaagttccaggtgattagagtgcctgccaagtgccgggattgccctatactatccacttcccggcgggtcagccggagttcatttcaccttcaaacaaactaacggaaaggctcacgcctatcacatacctcttcgacggttgtaggattattcctttgaggatgatgggccatcgatgggaaaaggtttctcaacttgcagaataaaccccaattcagttggtcttcaagtctgcttacgcagctattcccgtcatttgacgccgcagtgctaggtttcaaacgcaggaggttaaacagcttcctaattagagtacagacctggccgtgtgcttatttcttacattattcaaaaagaggtttaattcgtaagcggaatacatatttctgattcagcgtcagcattcgccagccagaccttctcatgctttctacctaaacatcgaaaatgcttctatatacgatgagatccttaattacctcgagcggcctcttctttctcggtatcgcggctcaagcctcgcacaccatcgacaacccactccccgttataacgccgcaatttaattcgccatctactgtatggaacgacctttctgatgctctacccgtggtcccttccagaatagagccatttgaatccggttactctttcgcatcgtgtggtgctggaaccggcgacggcgtggaggaatatgatgcctacaacatattttatgatgactgccccgaaccttggcaagtttgccttcacaaagataacggtatctccttagactcggtagccgaggtgcgtgtcgatgaactcttttctcttcaagaaaggcgactagtgagctaacaaaaccgatatggaagatgtttggaaaggtgcccgtaggtttcaggcaatacgtccgtgacttgaccgttggcaataattctgttgcattctggaaaaacacatccctcgtcatgtcgccgaacttttggaggatctatgtcatgatccacgaatctacacatgcggttgatctgcttagcacggcggatcttgtagcaatagatgctgggacctatagctactctcagaaatggcgcgatgcctactattccgacaaaagcgtccctactacgggttccaactatctctgggaggaaagctttgccgagatgggtcctcgggctttttatgactggtatgttgaaggggggctcgcaaatttccagccgaactggaatgaggtaagctttatcagcattcatcttgaggaggaaaccgagttgacatgatcacagttcgagaaccagctgtccactttcaagtctcttgttggacatcgggcccaacttggaggtaactgcgaattccgtgtcgccaatgagcctgcggtaccaacttcgagcacaagccggcgacgaaggggacctgctccggacattagtttcaagtcagacatccgtgtgattcgagtccccgataatctaccaacctttgagtacactgggtgatagcaaattaaagctccacgggtttatcaatttggaggttgagagttgtgcgctcgaacatgcacgtttatcatttacttgaggtagttttagataatatcgaagacttgagtctacccgggagaggctctacttgaagctgaggttatctagcaattgttacatagttgcgcgatatctttacttgttctaatgctgtttcgttgcattctaatttgagaattgttgaggctcaactatatacgggaattcctcctgtatcacatcatttgctattgtttatcacatccgttggacaattgtaaacttcagtagggcattaatactaggaacttgctcatattttgtcaggtaccctagttcacaacacccctttgtagcatcctacatgagtcaaatttttaaaccaaaaatccacttcataaccaccaatgaccaaagtacagttaattacctgatttgttaatttccggcactctttcttttccagaacctctgacagcatccgatgtagggtatcatgctccttagccatcttggctctcaattgaatcagagagtgggggccaagcccagaaaaggggcaacttaactcggcttcttagctgtcattacggtcagtggagggcttcaagcacacgaaggtgaagtctacatagtcacacaatcaatagtcatgctgtggttgcaaaactcacggtaaacaagtattatgactttgcattcgatcttataaggaaccgttccgatgcccagttgagtacctgattatgagtccctatcattagttccgtaaataagcttatgcaacgactgatagatccacatgctcttgataggctttataactagtttcaaagccgcaaaaatgcaatgttttcgaatgagtgaccgtatttccttgcattccttgatgggatacctgttcgtcgaccccaagcaagcattatgagggagttggtccggatgttggtttcaggtctacaggggtacccgcttgttacggtgggagctcagccttggcagacggccggctggctaactgagcggctacgacgccgggataatttagattgaagggagcaaaagcttctctgagcaccccacctgtttcgtttaaccatctgacgaggagctatcttgtttcaatccacgtcaccgtctgcttggcaagcttcgtttcacaaggctttggacctgaatcgggcaaccccacaactggaatcaagcctccgagtccgcaaaagagtagttgtctgatcagagcgttttggattgttacacaggatccagtacagctgatcgtttaaaaagtacttccctctctgacctttttctcattgcttgtatattcaatcatattctttcgttgttttttcccctcattctctacacagattcgcgctggacgtgactttcatttatttcccacctccttgtccaccgagattcaacaaaaatgcgtttcacgacttctgctctcttggctgctgcggcagcctcatcggcggcagcccaaagtgttgtgggaacggcatacgggtttgcaacgggcgttacgggcggcggcagtgccaccgccgtcactccctcttcggcctcggagctcgcttcgctgctgtctgacgacactgcgcgtacgatcatcatcgataaggaatacgatttcaccggtgaaaccgcggctgattctggctgtgaccgcaagagctgcagtgcagacaatggtggtcagctgtacctcggaaccctgtcttgcggaggctccgacaatgtggccgtcagctctatcacgtatgacgttgctggaactgaacctctttccgttggcagcaacaagagcattcttggtgtcaacggcaagggtgtactcaaaggaaaggggctgtctctgaagtcgggggccagcaacgttattattcaaggaattgaaatcaccgacctcaaccctggcattgtctggggaggtgatgcccttgaactcaagggaaagaatgatggtgtttgggtggaccacaacaaattcagcctggtcggccgcatgtttatcgtcacccattacgacgccgccagagtgaccatctccaacaacgaattcgatggaacaaccaccacatcggcttcctgcaattcacagcactattggaccgcgatgttctacggtgacggagaccaagtcaccctcgataagaactatttccacaatgtttcaggtcgcgctccaaagcttggtgagccgagcgtgaagggaactttccaagctgtgaacaattacttcagcaacatgcagggccatgcattcgacgcgtacgacggtgctacagctcttattgaaggcaatgtattcgataatgtcaagaccccctttaccgaccaggccgcaactgtctctacactcttcagcgcagactcatcctcagcatcttcttgctcaagtgctctcggccgcgcctgtgttgcaaacagcgcttccaatggaagtggaaagttacctactttgtcttctactagctctcttagttccttcaagtccacctatctagttgatgccattgccgttgaccaggttgctagccatgtgcagagcaatgctggtccttccaacttgggatcaagctctgggggatccgacagtggaaacgactcaacacctgtttcgtcgtcggttgccgtctcttcatcagttcccaccgctactaccttgtcattggtcccctctgctacttcagccccaacggcaaccgcttcccctgttcaaacttcagctcctgtctctggtggtgactctgatactggtgatgataactgcagcgatgatggttcatccggcagcgaggatgacactagtggatccgacgacagcacagaaattgccccttacggccaatgtggtggtcaaggttttacgggaactggtaaatgtgcctcaggcacttcttgtgttagccacaacgagtggtactctcaatgcttgagctctagtgcccggcgcagaaagagaggtcttgtcatgggaacactcttctaagtcaatagactcctaattggtagagctaatctttagccaagaattaatatagaacaatatcgacttagagataaatgcaattgagtaactagtgtattctagaatcgagccatgtcttaagttcaacaatttattctatgcctgagccagcagcccactatccaggtactccttgctgaaggggtaatctgaatacccgatttttgactgagggatgtagaaggtgttgcggttataaggagttaactgcaatccctccttgatacggtacacaagatctgggtttgagataaagtacctcccaaacatgacgacaatgctcttgtcagggtgctctacatccacaacactacgagcggtgtcggggttataccctcctgcaaggagaatgggtccgtcccaaaggtcatacacaaagtcgagcgactcattacttgagatatcctcagagccggagacccgtgattcaaccacgtgaagaaacgcaaggtttaactttcgcgctttcttgatcaggtccgaaaattgggggattgggtcctccatttgcatgacctggaatgtactccaggggctgatgcggaaaccaacgcgctcagccccaacagcgtcgaccattgccttcataacttcatgagggaaacgagacctgttttccacactgccgccatattcatcgtctcgttggttgctggtgtcttgtaggaactggtcaagaagataaccatttgcgacatggcactcaacgccatcaaagccggcctcgatggcgttcctcgatgcgtctgcaaaatcccgggtggtttttcgtatctcctcaatagtcatggcgcgaggaactggcgcatccggcgagaatggaatggcgctggggcccagaatcgggatgccttccttggctgaagtctcggccgaggccgcacgaccagccaagaagagctgacagtatatgaagctgcctcggcggtgaacctcatccgtgatgtcccgccacccctcgatctgttcccggctccaaattccgggtgcattgtcaaaggtgccgcatgcagatgaggcaaaggtcccctcgacgagaatcaatgtgcctggaacagcagcccgttgcacatagtattctttcataagcggcgttgggacacgatcgtccgtggccctgaggcgagtaagtgaaggcatgccgatgcgatgcgagacttcaatattgccgattttgagaggcttgaagaggcgagactcagacatggtggacgataagaatcgattgcaaaattactagaaataggtccaatttgcaagttgcttgttttttgaaagtcgatggaaagagagtccgaaggggataaactgctgggcttttatacagtttatttgtacaaggcattgcaaaaatcaactcaatacctcattctatctttcgaatgagattttggatttatcagcaatatttgcaaacgctatatcacatagtggcgatttgcaaacgctatatcacatagtggcgacagcttcagtttgcggaactaacatatttccattcaagggaatgaggtgatgccgcggctgacttgctacaaagactaaagcgtagtagccaatgggatcatgtaatatttgccggggcgaagcgtaaacaggaaacatcatactgcttaaaacggaatggcttcgtttaatctcccttctaatccgcctacttctccaccagtagcctctcggtacccgtataataatagcaggactacgttatgggaatcgctggatgtgattggtgcagccggcttgggaagttgtcggatctaaggtggctaagaccgtacgacgctcgcttcaatgttactggatatctcaaaccccgaacgaggtagtagtgagcaaagaaacagataaagcttctccatttgtgccagacttgtatgattacgctatcttgtttgatatacctcttcccaaaatcctcttacttgcgatagaaaggccttatctgaccatataaactgcttcataatggtgagaatctcaggccattcatcatacctattctcgaatctagatgcacgatgtaaatttaggagcattagatattgctctcgaacatctcctaatggggcaaaagcaccaccaatgtagataagccagagcagtagatcagggtgagaatcccatatagaatttacactctcctgttgcagcttttgcagcaacttcaatgagagttgtgactgtgtttctccaagtcagccatgtccgatacatgccaacagtgaataatggctccgaagatggcgccaagatgtagaacttaccggaaacactgacgctctccagattttgcagcgtaacatggttgagcacagataagcggcaatgttacaacactccaagaaacccgaagtgcttggtatgctgaccagccttgactgaatggaggcttgatggttgtcaatctgcgccatcgacatgatatcctctgattcgaaataggtagagtccctgacattctgcagagagtgaatatcttctagtatttcgatgaactctgggtttagatgttggagcaccctctgaaacccaggctgtaaaacaaaatcatttggggcaaatgggtctcttctccagcgaagctcagtgaatgtttcatggttcacgatccgtttagatccagtcatgacgcttgaattaagatcttgcctatatgccatgtgagtataccgaaatgtcgttctcgtgattgaaatttcaacatagagttatatttaccagaaaatggctcgcttaattgcgtccgtcagatgaattccttggctttggcatactccaagaagatgttgaatagcattcatatgaagctggacctgaaccggcattgaaagacgagcctttgagagtccaaacattagctttgtccgagtctttcatatcacgatatgtgggatagatgggtacagacttcaattcccgcaagcaggatgatagatgccaaggtggactcagaggtagccacatctaggcaactcattctctcacttattgtgttgatagccttgttttgaaaattcagaccggctatgccgagtgccccattcgtggcaagagaaaatgtgagcattgctgcattgtggagcgcaggatcacctggacgagcccgaaatacttggatgaaattgaaaagaacgagctcatccgcaatgctaaagattggctccgcagagtgctcggtcttgcctacattcatctgtgagcagtaggtagggcaatgtctactcaagaaacctactctgacttaaacatgtttgtagcctcgatgatccagaatctagaatgcgaatcaagtcgatcgcagtacctgtgcatttcacttcgggcgattcgatcatacgattgagttgtgtctttgtcgatgctgtagcccggctcgaatcctgactccatgacagaaggcggaaattaagcccagactgttgctgcgcttttcgctttctctcaagagcatgttttatagcatgcgaccgagctaaccgtttattttttcggtcttccacaccatccggacattgaattgagacaaagcgaaaggtgcctagattgctggtcagacggatctcaagatggagcgacatactgtcccgctacgactgggtctaggaagaatggcttaccatcggtcgccattttccctctcagctctgtcaaaccaacgtctgtgtccagatgttgacatgggacattgattgactaaaggagaaacaggagatcggcggagcttccatcgatcgttgtctttgctgacaaatacaaaaaaccaagggaacaacatttgccctaccctgtatactggctcgacatttttgctttgcagtaaaatattacaacgcattcactttaaaaggttttctcaaggagattatgattagggaagtattagactaactaggtcaacttccatcatgaccttgaaaaggtattgcttgttggcaatgaagataatttgagaagtgtgtggatgacgaattggaaaagtatcaatggtggggagtaccaatgatcctcgtattggaccaaagctttatgacctctttgtatatcgaaatttaatctccaagggatggattatataagaactagaatgactgactagcaagccacgaaagtgtcactgacaactgctcaatgccccctccttgatctgaccacgtatccagccgatctttcaccttgatcacatagtcttgccaattgatcggtatctcgataaattttgtcgattctgtgtcaagattctttgctcgagccgcagcaagtaggcacagagcgtgattgaaacgcacacgacatgcgatccacgagccacagtgacgatagaacggcttctctgtctcaatgcgataagcattcaaccggagaccgagggaagcttttgcgccataaagacgcctttgagaaattgtcagctgcgttgcgtgatcatgaacgcagatgtacaaaaatgctcggcaaagtaactctcgaacttcaacatatcgctctcgcatcagtttgaccagctccggctcggcttcggaggggagcgagtccggagggaggttgaaatagagacaagggggtaagcattccagccatctctggagctgttcttccaactgtgtgaacttctcggcgaccatccttgccccagatgaatcaagatttggcgagagcttagtcgccgcgtttcgggcacgattgagcagtcgccgcagtgatatttcagcaagaaagtagtaaaaggccgtcggtgcgcagttgcgcctgtctcgagcgtggcaaacaaataaccgcgatgtcggggtctcagacgggaagctaggtagctggaatgaaaactgcgagtcctgaagggtacatagaggtagatttggaagttcgtatcgcatttcactggatgacctttgttagttatctgacggcagaaggggagcaagaagacctaccactctgccttcatacaagtccagaataaccgctgctcaagaccttttagaatagagttagcagcgtttattagttgagaatttgcctttttgcgtacttagctcttgttgtgacctctcgctaccgccaagtgtttgtttctggtgatatgtttcccagagcatagacgcagtccggaacatcttccacccctgtactggttcgaaattataccaataccaagaactggggctcgacacgttagataaagtgtagtattgcctaacgttcttggagactcaccccatgaggcagtaacatgacactccaaggagggagtcgtcttgcaaagcgtaagacatccggctctgagccatggcaaagtaaatagatgattctttgaaacgatgctcaggcaccgctactgtgcgagtagggctgccgttttcagcattcgaagtgaaacgcctttcatcttcaggatagttgccccagatggcggctaacgcgaaaatcgagagcacaaagcatgaggagacggaatctttcaacccatctcgcaaaacttccagcacgaaatcatcgaacgtctcattgtcaacgaagggcgtcaatggctcaaattttgacaagtatatgtcgcgtaactcaagaatgcgttccggagatagatgtgaaatttctagagaacaagcatggggttaatcaccgctgtccatgttttctgtgtaaaaaggaaaaagtaacaaaccgttggaatatgggttcattttggcagagaaaacggaggccggaggcgttctgatgggtttgtcggcagggaatacattccatttcaaaatatcgtccgacgctgtgattggagttgagaggacatctttccgtgaatgagcttctatctcatcaccagtctcatcgacatgtagatcatgtggttcaggtggatgcccatttgtactgttattgctaagacctccttggaccgaaaggttcgcaatgagctgaccttgatcctcaatggctttcaatattttcccgcccaatatctcaaatctaacgaaatattgttagtgagttgataatcgtgcatacggccaagtcgaattcacctacactgatgatgggtctttgtccgggtacaaacaccgcctgcctcgcttctgacatttagcacagcttggacgagacgcatcacagcgggttttgctgattcgacaagcgtcacatgctaccgcagttctagtctgctgcattctctcggtttcagtatgcaagtcagccggcctaggacgtttctttcgtgtggtgaccatttcgatggatggtgtgaactctgatacatttgcttctggagttgacatcaccgttgagagatcctgtgcggacataggtgtgattcggagaagacgtacttgtatcggtgaatcttacctctcccatgaaaagcagcccctccccggagctccatttttccagggaagtacacgtcaaaagatcgaatggtgaaagggattaccccgcaattgatctctctcccgatctcgctctttgcagagatgacagttaagtggcgggagatgaattattgcagcataacatctcgagatagtgcattccctacgtatcgtttacataactagtttcataacgtgaagacgacttgcgacaccatccagttacgatcatttacgtgagaagaagttggccatttgatgttttagatcagctggataggaaccactgccactgacgaattgagtgaaagtaatcacattagctttttgtctgcagaattgggtatctaatgatgcccgaagacaacgagacgatttgtcatgtgagtgcggcggaggctccccgactatctcacccagaaagctgcaatacgacgctgcgacatacggcggaggctccccgaatgtctctgattggccgacattctgtctgctccgaccatcacgatgtgcgtgaggaccagaaacaattaagaacacaagaagaaagattgtagcaaggattagaagtcggtctatttaaagagacgggggccctcctacgatgcaatattagctcaacaagtctgaaaaaagcaaggattcaccagttcagtcagtttaatctgccagtatccagcataccaagcattttcatccttttatttaccatggctacaccggagatcaagaatgttatcgacagcaagaccttcaaggtcttaacccccgaacagattgaatcgttcatgaaattcgggtatctacgcctccctggagccatccctatcgagaactgcgaccgctggacggagcacgtctgggaacgtctggggatggaccccgatgataaatctacctggcatacggaacggaaccatatggccaagttggatgtggttcccgccaaggagattgcgccgcttgcctgggaggcaatatgtgagctttgcggaggagaggataggattgctaaaggtggtgaaatctggacaaacgggttcatcgtgaatctaggcagcaaggagatcgaggggaaaaccaccccgcccaaggatctagagttgtggcacgttgacggtgacttctttgtccactttctggatagcccggagcaagcattgctagtcattccatgctggactgacgttgaatcaaatgggggcgccacctggatttgtgatcaaggcccaagaaggattggaaaacatctggtatgaattccagatttcctagctacctgtccgctgtgatttgagaatattgctgacgactgaatagtttgagcacccagaaggcttgagccctgtgatgcagggccgggatgagccttacaagccttatgcatcctacgatcactgcgtttcggtcattcgtgattgtccggacgagagctttcatgagatgacgggcaagaagggggatgttattctcatgcatccacttaccctccatagcgtgagccgaaatggccggcgtctcaaacgtaagtattcgcatcgtgtctattgttttaaattatctatttttagggatgagagtcgctcacatatctttaggcatcatctccaacccgcccgtctctcttgcggcaccttttcaatttaatcgagcgaacaaagctgatcacagtctcattgagcttaaaactatacaagatgtcggtggtgggttcgaaaagttccgggattggaagattactggtgcgcgggaaaagttcgcccctttgacagttcctgacaaagagaagggccgtgaccgggaggtgcagagacttctcgacctgggcattgcagttggagagcccatcagccagatgcctcactctatggtctattcgtcgtgaataattttggaatgcaaacaaatagcactatgtaattgttgttcatcaaatgagcaattacacatggctttcaagcctaccgaaaacctcttgaatcagactggtagttataaactagccatgggggtttgttaagaagcaggattttatattaaatgcattactgtgccgtctctagcaacctaagattatctagaaagggaccttgaaagtgtattgtttgtatccttgtcttggccaagtactatcattccacctttataccgacggccacttattaatgttgctttggcatcatgactgacgggtctccctctctccaaatgaccttcaatccaaacttcttgatcttccactcatttgcgttatcctttataagatcaagggagtactgcccaccgaccaggaacttgggcccatctggctctcggccccttccaggaggacaatgctgagccagtgatgtggcagtgaggaaggcggtattcgctccatccttgagatccacacggacgttgctcacattgtgagtggtgtccatgggtccaaccatttcgaagatgtgctttcggatcagggcgaggttggggagagctttgagctcgccgtcgtggatttcggccgaggcatcatctccagcccacacggagttgaagagctcgaggtcgttcagatcgcaagcaatggcaacgcgagagaggacgtcaatgatggcctcacggggggtgagagactcgaggtgggtgggtactgtggaagacattgtgataattctggtagcaagataaaacaaatgaagggaagtggtgttagacgaggctctgaggatgttttctgagatggttccgattgaaggttgccgagaatacaaagtatatagtgctttggattgatcttgatctgatgagctgcttgtagtttctgatgcctcgaatacaacgattctcatctctcttttataataatggctagacaccctcttaggctccgacagactgtaaatgccggaggtgtgggttggtgtaagcaacgggcattagcaaagcccgtggccgccataaaaccggcaccatcggcgttttcgttgtcaccgtatacatatcctccggctcccccagaaaatctccggcatctcaggaaaattcactctcacggtaaatatttgctagcagtcaagaatcatggaagagcagaggacggcgcgcgctaccaaatggggtgcggcatgtggtccttgtgctgcgggcaagacgcgatgcattcgcagcgactctgaatctccgggcgcctgtgatcggtgccggaaattggggaagcagtgctctgatcgggctcccaggccaaggaagaagcggcaggctaagacagcgtacgtcgcgtttgctcgttcatatttcctctttcgttcatacccaccaccatcattgttatgacatgaaagtccgacgatgctcgagtggctgcgactggacattattagaccccgaatcatccatcgtttcctcaaacggctaacaagattcaatatgacagaaagttaccccagtctacggggatttccaatgacctggtagaagcattcgaagctttgggccagagcagtattgaaaccacgccaagcttcaatcaactcggtacatcgtctccagctaaaacaggatcccaagcccaaagtagatcaagcgaagggagtctgcccacagcgccagttcttgggttgggatttggtccacctcaatcatgcacctgcaacacatcagcggacaatgacgaccacatgcccttggagtctgacgaagcgttactggccatctacaggagccaactctctgcccgttttccattcgtcattattccagctagctcaacgccgagacaactgcagacggagcggcccttccttttcaaggtggtcagaatggtggccagtgtacgcaatttgtcctcgataagaggacagggccggtctatcctccaacacatctctgaagccatgctcctcaggtcagagcggtctatcgatcttttgcaagggatattggtctttctgggattctatcactaccactgtatgacccatgcgcagttcggcaatctcgttcatttgtccgcgagtctcgtagaggacatgaatttgaacgtatcttattcgcctcagaatagcgcgggcatccttcctctaatgcggggtcagggtgcgaggtcgaggacaaatgaggagaatcggacactgcttggtgtgtggtatatgagttcaaagtgagttggtgtcgtattttttgagttgactgccgctgatgctaacgttgtctcagtgctgctttggttaccaagcacttagggcctgcaaggtacacgaaagatctagaccactgtctcagagaacttgaaagtatcgccgaatatgagtcagaccagttggcagtgcagctggtccgctttcaaaacaccactaacaagatattccatttccactgcagagaccagcaaatggatgaactccctggcgcccagaaagtctcggacacggaatgcttggaagtgttccaggcggagttggacaacctatggaacgcgtcgtcccccaagctcatatccaattgtaggaagacccctcgcttaaagaattctcacacgcatactctaacacaacttcttgtatcaggtcttatttcatgtcactacaggagtgcatatcttcagctgcttgagcctctgttgaccggcgcgcacctccccggtgccgtatctcaaacattcgactcgctgtcactctctggcctattcaaagtcaacctcttttcgcatttcacggctgcgctaaaggcctggttcgacacttggctcgcgctccccgtgtgctcctactttcatatgccccagccggtctcctttcagctattccatgcctgtcgggctctcatacgatgggtcagggcggctggaccaaacgccatcaggcgccccgactctggcgtcaatcgatcacgtggatctacagctcctaagcaggcactcccagcaatgagcgggatcccagagtgcccagagctaagttcgatagagcctccggtctcacactcgtctgtaacgatgctcacacagcctcttgactcactgaaggctaaggtgcttgagcaagccgatcttcgaattgatgtatttggcctgttggattccatgactgtccgttttgagtctgcgagcaaagaaatggaggctgcccaaggaggtacgtggaacaacaatacttgggatgtcgctgcagatcacatcaggatcaagaaggcgaagatcgaaaagtggtgcgagatcactgcggcagtgggcaatgagggccgtgccgggcagtctaaccaagtaaacggggttgttgaggcacccggagagatccgagatcgagatatggcagcagagtggaggatggatggctttgaatggcacgtaccgggcgatggtcaggagaacggacaatgggaggccgagcttttcgatgaaatcatgatggatgccgatatcagtgctttcttggatgtgcctgggatttggggaacagatgcattggacgacatgggagcgacaggaagactggccacagcgaatgcttcttactagtatgaacagtatatggctgagtcttgtacaaaacgcatgcaagaatatgagttaattaacgctttataagacttccaaggtttcctcaaaattccaaaacttccctctggtatcattctaattagaatcacttttatcggcccggatgcggtgctcgtctatacccaaccaacatcaacctcttctagttgtgatccgccgctctgaacatgcaaatatatcatatcaatctctagtattctatcatgcagtctcgttccataacatcctcattgaggcagaagctgggtatgcagcaagcagtagcgaagcaaactcgggcatgatgcctttggccattgcaccatggaccgtgacaggagcccatgagagctgcttgaggaacttgattttccacttcccctcccagtcctgctgtgcttgtctattcacgcacggcgctcgctgggctctctgcgtgagcaggtacaccaggtcgatgtacacctcagccagccagcaaagcgcattaatcttgtctaaccggctgcacgccttgggagacagacgtattattttcttcttgctcagccacggggctgcatccgacacatggtaaacagcagcgatgaagacctggatcgtctcaaggccgagcatgaaccggcccgaaggattgaggttgctgagctgagtacgaatacgaaagatgacgtctttggcgtcaacatacacgcccagcaaacccagcatgcggttcatggtacgccagttaccaatcatgggcacgatgagtttgatgatgcccgccacccgacgagcgagagcggccagaaacgagagtcgagcagccgagcacagtgggaagcggacgcgtagcatgcgaaagagcctctgggtagccccaaaggccggctccggagaggagaacgcatccagggagtcgcatatgatgcggaggcagttgctgatgaagaagagggttgtgtcagtgccgctacgcgtgttgatgcagcggcagaagtggagaagcagacggtcgaaagctgagctgctcgtgtttggggcgttggccagagcttcctgggccgcgatggcatcgggagctgttggcagggcggtctctgccactggagggtcgatcttctctacatggcgcgcatcgtatgctgaggctacgctaacagtagggaccatggttgagccgggacttgagagtgtgcgtgaggcctagtcatcgggatgaaatctcatctggtccagggggatcgccaacgagcagacgcgtggctgggcggtgttggttggccaggtgagcgactcgcgaaggtagaagaaggtctcgggaagtgacccggacaccgagagtaaatggacgacgattagaagcgctatcagcggtcaagccgagaatcggatattttatcaatcagtcagtctgtggggagcaaagtggacgtctctgatgttggattcgggagtcgggatggattcgcttagcgcagaggctaggcgagaccaagcggaccagtgggcagatgggagccaaagtctgtggagccgcgctgaggcaattaccgtatatctcgcatggagtggacctagatcaacagtccatgcgaaactcatatcaaggagacttacgtctgtggaagtctgaagcttcaattccaattgtctcctgtgttgctgaaacggtatttcagaggtgcaacgtctctgttcccagtttagcctaatttagtggggcccgcccctaaatgtctcgccgttcagcggtcacaacggcaaaggtcgccgaaaatgccctaatcgagcggaatgaccacctgaggatggccctaacgccgctccacaagctacaaggtgctgagagcaattaattatggcataccctgtacttcaacgtagtatatagttaggtagatagtccatgtctctctaacgaggatatctagattgtgcatcccgctaacatccgcacaatattttcgattccataattggataaaggtgattcagcaatgagttcttttatgcacaaaactgagttgagaaaacggaagcctccaacaatcaacactcaacatgctatcatgaacttgacagggaaaaagtcttttcaacgtcagatactcctcctgctgtgatcaaatactcaaaactaggtgtgccttagtcccgcccaagaaggaaagagtcccataccaagactaccgcatcccaaagaaaccctagataggaaacaggtgctgggggtatcggccatctatccggctcagcttgaaaccaacccttgatctccttctgatgtacaatggcctcgtaaggatcaactgtcgctcgagtctgccgcactagctcgcatgcttcgcgatacatggcttgcctcctttctggatccaaggagaggtgtcttattgaaggcaaaatgcatgctatgtcatggtcgccgttttcagtggccatggatccatcgaaaattggcatgggccttaaggtcaggttttttaaaccagcgcggatgtcgagccgtgccctcgaactcacgatccacagaggcatgtcttggtgcccaacgtccacgatgactgtgtagtcggtactatcattacagtagggagccttggagagctcgctcttgctccgaggcttagcccctgcagccttggttctgactaggagattccctatatgtaccacgtgctttgggagaggcaaagagtggcgaccagttgaaaggcgaggagacagctcaaagaatgacaaagctgcgtttgagtcggtgccttctagtcgcgtgggacagtacacggaatacagcgtcgctcgggacgtgaaatcgatgcggtagtcatccccattggcatcgaaaagagggattgcatgcaaatctggaccgtgccaggttgacaaaaccttttcggccttttcccgcgaaagagcttgataggtttttatgcatttccgagtgacctcaagctggtcatagtcgacattcgacatggacgcacccaacccctcaggtgtgcgtgtctctggcggccatcgcttgtccgattccagtgaccactcccatggattttcccaggtaatcctgtcagaatggctttcatgaggttcgagaatgagattttcgaaaccgtcgtcgacagatggcttcgtggccaagcagatgtcactttcgtccactgattcaacttcgttgtctggaggagggttagtaggctctggggagacatgacttgggatatggactgaccttgcccgtcatccgaaaattgttcctccgggggtacccgagatggggagacgtcgtcaagagccatcggaatgacgtggccaagatagcgagggaagaaaattgaagcgcgactggtggcacgatgctcagtgtgatgatttatatgagaaaggaagctgtcagcctggattcatgaatcgcgatgtcaaggcagatcctctaggaagctggcgacaatgccacaattcggtgccttggaggggcggtgcggagagaattcagactggccgtggcctgcgtgatgtctggtgtggagattttaattttaggattgggtagcaacctagaagaaagtagggcgcgtctttaggcgccaaccctgttgatctcgccacaaatgctgccatccatcgcgcctacacactcgcccactcggacagtttcagctttccccacggccagcgatgatggcttggttgctcggatggctacctatccaacgaacaccaacagtcatggcgcatgcaggaggccgtgtcggtcgactttgccgcgcggactgcggcggccatctgcggccagacaacatttaagcgctggccttgtggagccatcgaatcatgttacgaaggactagggcaacgcgttaattgaaacagaaacatcaaattgggagccctgaagcgtaaggtcgatgaagcttggcgccagccgttcataaagttgtcagttggctggtcctctccaagatggatatgatttccggcttaaaatgctcaacttccgcttctaagtatgctttcccattatcccattcttctcctctctaatttgggcaaactcattcaataatcggtaaggctgaacaggtttaacattggcatgtgaacatgaactgatcaaggagataatgacaggaaccgcaccctaacgagtttcaccatgggtatcctttcgatctcgaagggagccgaagctgatatcataatcccggagatagaagtagcggaatcaaacttcaaggcgctggtagacgccgctgtgacaatctcgtctcctagaagtttgctggtcagatttgccggcgagatcgacatcacaccgctcacaagtctggtaaatgacctgatccgtctttttcatctcttccgtcgcattgcagagaatgcaatcgatgcccaatctgcattgaaagaggtcccaccaaacatcatgaagaacaaccattacaacactctctgcccccttacagtgttccttcggatcatcgccagcgctctcagccgggtcaaccttcgaaaggtgaacctgaatgatatgttctccgaatggggtccaattaaacctcttcggggcgtcatggtccaacttcagaagaactttcgaacaatccaaattagagccaacgaaatactcccaggttttgcaaactgcattgtccttcatgaggaacactccaagttcacggtctcgcccactgcagcggcatattatgccctggcgggcatcagtgcaactgccgtccgaagcctttatcttcaaaaactcagggttggttgcgaacctggggtgcgcgagcgaattgacaaaatagaactgctttcgcgagacttggtgaattatcacaagacggtaatgggtaaggagagtgatgagtggggtggtaatcctttcagtggctctggcagtaatcgagtcaagattggagggtttggtgcatccatgacgccaaagggagggtacaagctggcgtgttttgtcgatttttggcgctttgagatggagaggccagcagccgttgaggagcgtgccctgggagtgttgactgcatcattgggccaaagaggcgcatggaataccacctcatgcgcagaatgggagctctggctcactaagctgtctcgtcaggacgttcaacccgtcccgttcgatacagtttaccccgttagggaggaaatggccaagtctgctacctggacgggcaaggcttccccagccagtgccactcgtgctccttcgagtggcaagagggccgcggttggttcgagggtagaggtggccgcagtattgtgagacccggcattatactccattgagtccaggttgacatttccagaaaatggggagaagaaaccaacacccggagtagcgttccctcgttcccagaagacaactcaacgtcaacaacccacagtgtccagaggtgggccatcgttagaacctgtgcttgccaaaacgaattcctttaccattcaaagcaggcgccccgaggcacagttgacgccagatctacctggaaagaagagaggggtgttctctaaaatgtttagttaatgggaataattttgtttcttttccgaaggttatcattaggggggtggattgcaacattgctggcgttcagtttaccattcaattggaagataaccattactatctagttagtttccatttgaacaatgggcacggtttaactgttattacgagaactggacctcttcctgtgcgcctattcgatagctcgttctttgtactggcgtgcagagtagtactcatatcgtgaagcacaacgagctctgaaagatttgccccatttcagaagaacagcaaattggccgagtataagaacggaaatcaaaagaatgatgacaaagacatatgtaatgccaatctccctaatccacggggtgagggcaaatataaaggcggtgctgaaagcgttgcgaaccacagttacgccaacaagtgcgtctccgatgacctgcatcaggttagcggatggtaaaaagatcggaggtttgcaatcgtacttacattttggtaagagtcggtcaaataagtcaacacaacactgttgattggggaaatacccatgttgtagaggacgacaccaagggcaacaaggggccatggtagtccgttacctagtccaatgccggtcaaaatggcacctgctggaaccagaggcaggaaaagacaaaagcaccataggcgggtctctggctcatatacacccttgttgcggcggcatagaaagacaacaagccagtcgctaagcggccctccaacaacacagccaatagtgacgccaataatcttgggtagactcatcaacccgatttgagctgaattgaaactgtaaggaggtttcttcatgtatgtcgaaatagaggtagatataacatccccgagcgctattaatattccatagacgagagcagtaaaggccactgcaggtatggtaccaagtaggataaaaggctggtacatatgacgcgtaaaggacttcagccttgcatcagaagacactcccccagttagcgatagcttcgccaggtaggtcttttctgggatactcttgtcaacttggatctcatgcaagtttgtgttagaccccttctcttcgataaacgcggaggtattggcatcggttctagcttggattccgtccccgttttgaacaccagaaccagactttgcagacttctcttgattagaagccccttcagactcgacggggtgagtcgatgatgcaactggctcctgctcgggaacgaattttgtctcttcgtacaagaaggccacgatcagggccaaagctccgatgaagatggcatttccccaccacacccatctccaaccccggctgagggaaacatagccagcgagtagggatcctaaaggggcagcaactttccacaaccatacgtagatgctgttaaggcttccccgctggtgtacaaagaagacatcggcaatggtcatctgcaccatgacttcgccaagagcaccaaacccacactggacgatgttgatacccatcaagtctccgtacgtcctctgcttagctgaccatatcgccacaagaaactgggcgattgtgctgaccaggtacagtggccggcgcccaagtttgagtgcaaatggaatgaggaggacagatccgattcccaggaaggcacagccgatggcatagctgttgttcaactcgtcgtcactgaacccaagctctttctgcatgggaccccacgtcggagtcgcagaagaggtgaactcggagaccatggcggagtaaaggcatacgatggcaaagttgagatacttgcgccacttggcccagttgagtgggtcattggggttggcagaaggtcgaggctggaggataatttctttcttgccagacgccgcgttgacatcctcaagcagaacggtgcctggaggccacatcgtagcgattccagcatcaacgtccacctgtgtaggaggcatggtttctgctctgaagcgatacaatagggaacagagtttatgagtctgaaatggccgagtgagatgatatcctggtagaggagtagggttgagtgatgcgctcttaatctcgactaacatgccggggcatatttatagacgcatgcgcgctcgatggctgcagaatctggggaacggggaatcaagacaatcgcaacatgcaacctagaaaaatggttgatatgccactgactcgtgattggagcggtctcgagcccgccctgaagctatctaatgtggggtaatgggatcttatgctataacgatatttcactaaatcatgcccttttggacagttggtcatgggtgaagcggcgtgggtcccgaaagcctggcgcgtgtgcttccgcatcacaggacaaagtagctcacgaaatgtaaaccggaggcaagggtcaagaatgaaccagtctgataagaagagatctggaaactatcgacttgactcgaacttgttcagtcaagctcgttgcttaagcccacctaaccgccaaattgcagacatgtctccctcgttgcctatatctgattctagcctctctttctggcaccaaactacacgctcatttgctcacctgaacagtaatcgagatgtgcctgtccccttgacatctcgatatgctatcattggatcgggtgtttcaggggctctcactgcttgggagcttataaagaatggtgtcaagggcgaagacatcctgattctcgaggccagagaagctgtttcgggtgccactggaagaaatgctggccatgtccgacctggtagtacgccaactccggtcaggtagcgttaagatctaacctagtctcccagacgcgtttcggggctttccctcttttgcagcccggcacggtccggcgcaagcgaagaaaatcatcgaaagcgagcgagtcgtcctacagaaagtgaaagattttgtagagagtaatagagtagactgcgacttctatgacacgacgacgatcgatgtttgcctctccgcagattttgccgaccaccaatcccgaagcttggctgcgttcgaagctgcgggaggggatacctcacatattcgaatgtatcgaggcgaagatgcgaaggagaaaacaagagtacctgcggctatatgcgcatatgagtggccggcggcgtctaatcaccctgccaagttaacgcagtggattctaaacgatgtgctcaacaagggcgccaagctatggacacattgccctgtatcaaatgtcaccaaacacaacggcgagggacaagcgagcaatcttcattggaatctgcatacaacccgcggcgttacgtctgtcgatacagtcatccactgtacaaacgcccacgcagctgctcttttgccaggactaagcggatttgtcactcctctgaagtcacaggttcatgcgtttgtgcccactgcggctgcttctgctgaaaatctatttaagcagacaatgtcacttcgatatagcctcgggcattacttctcggttaatcaactacccagagacggcactatcattatcggcggttctggaacacgggacgacggcgatattgataataaaatgaaagagggaatggttacgtttgacgatagtcagtattctcaacggatcgcgaaaaacagcaacagagaatttaagaaccttttgcttgagcctggctccgacaagctacgaccaggagaggggcttcggcatgcttggacgggaattttaggcatgaccccagataatgttcctctagttggaccaatcgaggatttggaggggcaatggatctgtgctggattcaatggtcatggtacgtatcccatgaatgttttggccagcgcatctgctaacttgaggatataggcatggctaggattttcttgtgtgcccctgggttggtaaagttgatactagggaagccatggtcggaaactggtcttccagaatgtttccaatatagcacggaaagagtggatggggaactgaatgcgcaactaaatgggaagctctaacacacaagcaagtctacgtagccttttaaaacttacacactgctcgctcgttatgatatcctcagcagcttctcaaacttgttttcaagtgtatcgtgtagctacaaatgatgccgtctctttttgtcctccctcatcacgtaacatcatcaacattcttcaacattcttcaacacaaggaccacctaaagcttaaatcaacatgaagatgtcgtaggcggacgatgtcttgtcccttagcttcagcaatgtacttcatcaaagccggtcctcataaaagctgtggaaacccctcgattgcaacatatacaaatagtcaacacccttcaaagacattgaaccgcctgattattttcggaaagtatatcagaaaaagcataaatcccatgatcataaaactgcataagagaaaaacattgattttggtacagatctttatgaaattaatgagaacatataacttgttgactaccgtaagagagttcggctatgagggaaaaagaaaagtacatatttactacaatacaaagaacgaaaatgcattacccaaggaaataggaaaggtgctttccaagaccactttcatcttcgttcataatatactaatgcaacagcagcatgaaaggccctcaatggcaatgacatgggtgtcgggtgtggggccgcccaggctccactctttccgcagggtcaatgaggctaattgatttctcaagatcaaaccaacataccttcgaatgactatctgggcgcttcgaggctgtcgatgccacaagactcatagatggagggcgaagagtgaattttctggctaaatgaggctgcgtgataagcgaggactgcctactagcgaatatgatccattaatggaactatcaatcaggcatcaagctaggcaattctgttgaggaaagttcgccaaattgcaggtagatgctcgctaattcgtagtgggacctcgggcggaaggcacaagattttaggcgtcatcccactataggggatttgttcaagtgtgaacatcaatgataattattggcttcacgaattcgaatgaatgggatagcctctaagactcggctcgatttctgatcacaagaaaacactcactgatatttaccatcccggctcgtagttttcctttctcggagcttgccacccgccgttattggctttgttgccgtgaagaaatatatttcccttccttcatggtcaagtgatatcgaccgttgctctcacgtgacgtcgaccaactcaattttcacttgcctggcgcggggttgtttagattaatatgccaggacaattcatacacttagtccgatgactcgagggagatttaatttagcacagaaaatacgcatcaaaaggattccagaagtcatgctgctgggatttcccaaggaatatgtcgtcggctcgcgacaatgaggctgtggaagggagcgctggcccgggtcccaggtatcatctcacggcttgcgtacgatgccgacagaagaaaaaacgatgtgatcggaagttgccggtatgttatacttgcatgatattaatggaatcagaaccaagctgatatatggagtaccaagacttgcaaactgtgtgaaattgctggggttgaatgcattgaatatgattcgatagctcaacggcatgttcctcgaaggtgagactcagctgtggccgagcgtgctctacaaacctctgaccggtgatcgtttcatcagctacgtccagaacttagaggaccgcgtggcatatcttgagacaatgctacagagacatggaatcaactacttgagccctggtagtatggccgaaactgttgcattttcgccggcggaggcgttggctgagccttcaaccacgtgggaagaaatcccagaactcggttggcctatttcagaacagcaaaatcaagtcaacgcacctcgaattgaccagggcgagccggtagcatcagccatgtgtcctggttgcgcagcgactgcggccgctaggaacacgagggatacactggatggcctcacacggagcacaccacatcacgagctaggattctccaagctgctcctttctgatctgatgaaattgaaatcaggcaggcgaatggctaggtctggacaaggcgaagtccaaagcgcattggagaaggagtcttcgccagatttgatgagtggcctggacacatccaaggcatctcttcctactcgagatgcggctcaaaatatcactaatgcatacttccaatgggctcgccttggaatgcccctacttcatgagccaacatttcgtctgaagctggatctcctgtatagaatgccgccagaggtcgactttacctcgactcatactagtaacgaatctaggatggcagttttctttgtctacgaagtctttgcggtggccctcatggtcatgcaaaaacaagacccctcaaagatccccaccttcatggcagaccgatatcatcgaactgcacttgcagcgctagatgaagtcggccttcctacagatgtggaaggtgtgcaggctctcctccttgtcgctcagtactcttaccaccaccccatagcctgggccgtttggaaaaccataggcgctgctcttcgtctcgcagttgagctgggactccaccaagatgcagagttgtcagaagatatcgacgctctcaagctagataccacgaggagggttttttgggttgcatactcgatagatcggagtgttgccgtcactctatcgctcccatcttgtctatcagatggtgccatcaatacaaaggtaggtgataatatgttgaataactctgggtttctctccgtcttgacttccagtaaccatgtgttagtttcccagcctcctgaatgacgaatatattacgaaaactggagtagatatgactcaaagccggccattttggaccaagagcataagcatacatttattccgctaccgccggcttcaatcagaaattcgaaccatgttgtacgagaatctgccttcagggcacttatcggtgaacttgcacgaatggcaaaaagatatggaccaaagacttcatcaatggtacgacgaagtccctcgatccgagacattaaacaagtatgagaagacagatgtcgagaacttcgaattgtctatgcagcgtgcgctgcttcttctctaccaaccgtcaccaaacatgccagacccttctggtcccactttgctggtcatttccggcattgctagcaaattgatccagatttaccgccggtatttccgtgagtacagacttacgatttactggcaagctgtggaaagtctaagctcggctggaacggccctcatatttagttatgtgaactcagctcaggttcgggactctatcccactcacacagctggaatctttatttagtacatgctcgtcggttctttggggaatggtagagcactttcccgcattcaagaacaagcgagatgcttttgacatcctggcttcaaagaccctagccgatctctctagtgaccgaacagaagtcttaggagattcaagcaaacaggcatattatcccggcacccagtgtgacacatcaaatgtcattcacaacgacagtttttccgctgtctcccagctagagcaaaatcagcaaccggcatttggttgggctacgcaagggaatcattactatccaggcacaaccacctccaacacgcgcccagcggtacccaatgatccttcacataacacagattcgccccaaggtggaagaaacgtgggcacattcgatactcaactttcagacgtggctttagatggtcatgagactctttttcgtctctctgattggcaagctgtgccagatacaaatgacgttttcgcccctgcctggatatagcagcagccatgggggctctaccttactttagcatcgtccgaaagtgaggaaaatagaaatacaagctttttaatcctagatccaagtaaagcttggtacacgacactcaggttatgagatattgaagtattcattgctaggctctatttgaaaccctatctagacctgacgtgcaaagctatccgcaatataggaaccaatcatacataggtcaactccaaccggtaatagctgaaggaacaaagtcggcgcatccaatgacatgaacatgccgaggacaagcgaaaataccagcatacccagagctggcaacacgtatcttgacctccatcgaggttgctggaattggccaagaacgcaggatgtatgaataacaatcgcacccgacagaacgatgagaattgattcgcagttatatactcggagtagtgctggaggtagcgggaccggtggtgtcttcaaggtcgcgggattgcaaacctaaaagaatatgtgttagagatggaaagctgagaattggagggagtgataaaggaagataccggaaatgtaattgaagacccagagcgccaacaactccaaatatcctgttcctcacggcgaaagacgcaaggaatagtaacgagggcaacagaagccaccgaagcggcaaaaatccgaatagaggaaatccccgggtccctcaacggtggagtgtcgagggaaaagttcagacagccatcagtagtcacgactttctcctggggtctctcctcgagttgggacacatgtcgagttggcttcggagacaaggccaaatgcatacccttctttcgcgttgggatattgtagaagaaatgatggaggatcgttcttttccgcgtgagtagaaggtgtgatgatttctagggaaggaagttgagcagaactaaccgagaggtatccaaggagatatcagcgagctaatcatttattgaggaactctatttacgaatcaaattgcagagcgagagaggggtaatacgtggcgttgtgcagctgaactcgcagctgacgcatccttgattcgcccagccccctttcttgtgccaatgagcttgtccaaattgttggtttctctttcctccgctgcgcccagttcaatctttggtgaggatccttctcacactgctgtcatcaatcacatatttctggagctcccaccatccattgtttttcttcgtgccagagctactctccgtatctacacccaacctactcagcactctcactgaaatatcatcgctcgaatctcgcgatacacaaagctgcgataccaacctcaattcaatgggaaccgaatggctactctatacgaacgcttgcctatcgctcctgatccttctctccaggagccagcaggagagtctgagttggacagcctatctcaccggcctgtaaggccagatccgcttgccgcacccaacgctccgatcgcatgagaaaactaacacctcgggagctagagtcgttctgacctgggcaatgacgggactatgccttctcgtggtacaccgccggcttgttacgaagtaagtcaccaacaaacagaaatagacctcaacaatgcaacataactgacagtggcacaagataccgaatgacactcatcctcgtgacattcgctatatgggttactcttcttttgatgacatcacagccgcctttatccgaagctgttctccttctccctttagctacgacgatgacgaccatacttttgtcgatttacacggagcaagaacatcaacatcccctcccactcccgaatacgatggttcgacagcgacaataggcatgttcgagttgcagtctgaggaggaatacgaaagagcctcgacatttcttccccatctgagggaagtgtttaacgatacgaaatcttacgaagcacctccagatgataaacttcctccccgtcgtcgacgaagacttccggagtatgcaatgatcgaaaatgaagaagaagaggagaatgctttgattgtttctcgatccgatggctacctccacctagcgtgccctttctccgtcgccaagcccgagaaatacaagtcttgccttctacactactctcttcagtctattgaggatattatccggcatgtgactcaacaccacaaggagccaccgtactgccctatatgccgacgggaattcgacagcccgtcggtacgtgatcagcatgtactcacgagaacgtgcacgttccgagactctggcgaggtcaaagacataaacgaacggcaaccgttacggctgcacaagcaggatgtggtacatataggcgagagaaaacgctggtcacatatctgggagactgtcttccctgattctctgtgactcaaaccatcttatctctatgagatcaagaatagagcgatgctcatgataaacagctattggggaactgcggatacgatcatgtctaacgagcaaccaaacgatatccctcacctctattcattgattttgcaaataccaggggctgtctgtgggttggcatggggtgattcatataatcaacgaaagaatattaagatccaggatatcgggttggggggaagacatcgccaaccaatattataagtgcgagcggaaaagcgctctttggaaaggtcttaagggaaggtgtgatctattagccattggcttttgaaacttaacctcattgcatcatgcaatacatttaaccgaagcaaacactagtgattcttggcctacttattcacttaggtagggttgatggattggctagttttattacagtgtcagtagaaaacaaaatcaaacccctaacctttgttttatatattttctattaagatttcttttcttaaaagctgtatctttctaaactttgtagtcatcaaaataatttgattaactgtgcagatttttccttagaacaaatccaacacagctgagagtacgccgaaactctgtctaccttattagttattgtctaaagggggtgaggaggattatcatccgcatttgatcccccgcttgttagagttattactgccggcatagctttacccggaaggccatcagagtctgtttcgatttgtacgatcttctatctaccgtagatattttctaagtgcgcaagcttcgtcacctttgcctaattcacgaaattgtttactaaataggcgccttggctcacacaactgtgaccctaacgcctactctgagtcaacggccccatcatcaatcacggttcgctttttcttcatcatgcaccaccacacttcccttctccaaagtatcgacacgggaaagaccaagatctgtctccgcaagtggtcggttgcgaagctgattccatacagtcttgtgagttggtcgagaaaataaagcatccatatgttccagtggcacacctacatcgatatcgtgtcagaaatatatcttctccaccatagcagattcggaaagaatgactcttacccttcgtttcagggatacagaagaacgcccagatccccatggcaatgacaaatcctccaaacataaagaatgttccataaccaagatctgtgatcatgtacggcgtcgctcgggccactacaaaagaacccagccaggtcatcgcagtagatatcgccacacacatcatacgaacatcaagcgggaagatctcggaggcgtaggtccaagtaattccctgccaagttgcacaaatgatcgttccgttcaaataaatgcaaacctaaatcaatcagtctcgtgcaagagatggatggtcaccaaacttaccatggcgaaatacgcccatccgttttgttgtatgttcccatcgaccgcgttctttgcgggatcggcgattttcacgtagctgcccacataccaaagcggcaggcaaccaagaaatgagccccaaaggagccctccgcgacgtccaacccgctccacaacccaaagtgcaaacatgatcattcctaccagtttagcaacgccatatacacctgtacttagaagcttgttactagttcccgtgacgccgagagtctcgaaaatccgaggactgtagtaggtcatgacgttgactcctgtaaatgactgaagaaacatgaggaaagccccggcaccaacacggttacgagtacccttggttaacagcttcttgaactggtttctgaagtcgctgttggagcttctttcttcgacctgcaggcggatctctcttatttcgttttggatatagggatgttcggaaggcaggttgcgaatcttgaccaataccctttcgcactcctcaaagttgtggcactttgcaagccatcgaggtgactcggggcaaaatatgataccaaaaaacagcaaggtggcagggagacattggagagccaacgggataatccactgtgcgtcctttttcacgtcgatcgtctggttggtggcgtagttgatccaaaacccgagcataccaccgctctgcgagacaacttcaaaaagaccaaccagacggcccctgatactgggcggagcagtctcggcaatgtacacaggaaccgtcatcgtggccatgccgattcctaaacctccaaccgcacggccagcgatgatcagctctacgatgccattcgcagcacacatcatgacaccaccaacgatgaatatggccgctgccagcatgatagacttcttgcggccaaacttttccgcaaatggaaatgtgagaagtgaaccgaagaagcagccgacctggaaagtggatgtgatattggcttgtgtgctatcacgctctccacttggcatatccttcagaccaaatttctcagtgaacgagtcgagagccattgtcccaccaataacagcggtgtcatagcccactgcattgaatcaaaagttagtatctttgttacaatatgcgggtgtcaaaacatgacgggagtattgcaaagagggggaaaatgtactagacaacgccgccatagatgccacaagagcgatcaaatgaatcgtccagttgcggacttcaggggggtcatttgtacccttggccgtggcgaaccccatctcgttctgattcaaatgagagtttctttttccgttacacaaactttctataaaggagaaaaattgacaagcatcatggaacgaaggtccagtacgctgcttttaagttgacgtggtcttctccccgcatctggggaaacacaattaaacagttgtattcccggcaagcggccgcacagtttccagcgtgtcaccctcttaaatgaccaggtgactttaacctacctctggccgtgttccctgtcacaagtggagagtgaagggatcaaccaatcgttgtttaggaagccttgctgtgatattacccagtagctctcctctccgcaaagtcagacgtgcggggaaggcggggtggcaacagccaaaaagaagcttaaacgtggtgcgggttttgcgggaaatagccgaagtgagattctttatattaggttgctagtaggtgtggttttgttcgagccaaagactccagtcggcatcaattcttgttgacatcctccagacggaatcgcctctcggtcatggctacttcttccatcataacacgggctgatgtaataatataggctacagtgcttaaactcctcgtaaagccccgttcctccatcattctcttaaggagatagcattgggccttcaatcaatggaagtcctggcacaaggttctctaggggtatatgagttatcctcgccggcaaggagccccatattttagcttggccggtttctgaatcagaacggcaattttaagtaagccgttgtggttgactcgttgttctataaagcattagtgctaattatttaatattgtctatgagttcgaagatgcaatggaacataaacgctatgcaccgaccagagttcgaacgcgttctgtgtcttgaacacaaagaagaattcatgtctgaagaagctcatcagaggttggaactatgagaagtctatgaattcattgttagatttcacggtaaaaacaaaatcattttataacttaaaacatttaaaagtttaatcgcattgtttccggatattaaaagaatgggggggctgtctagggtaggtcaaggtggcagacttgatcacgacttaccttaacatacgaccagttaatcttatatgcggcatcatggcagattttatctaagatgtaaaattcctcactgttcaaatcctcccctcaatgtatactgtccgcgaaatacatcatcagccaaggggtagtttacctgaagtgttgcctcaaccaccgctagagtacctacccgatagctgagctcacccctgtcatgtcattcaggggaagcagctcaaatgctagcacatgcttgaacgaacaaatgttgaactcgtaatgaagatgcgctctgctctttgttttggtctgtctggcgcaaccttccatgtgattgaatgtgtatcatagacacaaaagtgcctcttacatgtgccaccgaagcgactcgaaacaaccagtcacagtgattccaacacgtatcgaggaatgaggcacatcgaaaaagggccgggctgagaacagtggcacgataattgatggcttggctgggcacatgaccagggtgtgcccgcggcctcccgccaaacactcgaaatctctcgcctcgctccccgtgatctgcaagagccaagtgtgcggtgtcaatctatgtgtcttcttttcgcgtatcgccgatggatgcagatggattgatgatgcgcgtcggtgtcgagaagcgcgtgaatgggaggaaggcaaacaagcaagcatctgctgtcaggtcgcattcggcgggtcaaaatgacgcctcatctcatcgcccttcgcttcagaccgaccccctaaaagctcgttaatcgggcctgcatatggtgccggggcggtgcgagagaaaaaaaaaactctgctgcaggacagcacaggagaggggcccgacaggcatatgaatctgatttagtgagccacacaggagtagatcaatacgcacacgaggatttctaaggacgtgggaaccaaggaaacatccttgccagatagtggtgcctgctccaaaaccattcatttgaatgcaatcagaccagatgcctccatataaggccatgataggccagctcgaccgtaggcacggatccagctccaacccaggctaatcttagcatctgggcctgtgattctgacacgtccctgctctcgggcacccaagatcaggagacggcccagtgtcggctgatggcagcgctcagctcgctcgcctgtgctccccgccccctgacccgcgggatcaaccctactgcgcccactgcaatggcgtgtcagatctgactgcaccgcttgccggaagaacgttgcatgatgtggtactgggtggaaatcaggctactgggcctctctgctgcaataagccgccttgtcatagcccaattaggagcgctgcattaggctatcaaacgcaccctgacgaggggatgtcgagcctttatattcatactatgtacgccttttctttgaattgctatacgtatttgtcccttcaagctcaaattattcttcacaatattctatcactcatccatttcatctctccatatctaccatggacccatctggagacacccggtcaagcaaaccagacaagctctcccccatcaacgaatctgcttcttccgcacaacatgaagccactaacaccgaaatccaagccatcgcctcatgcctcgacagccctccccagaagagaaaaagacgggctgccgttgtgggtctgggaatggtcggcgttgcctttgtcgagaagcttctcaactacgatgccatgagcggccacaacgagtgggaagtcacaatcttcggcgaggagccatatctggcctacaaccgtgtcggactcacacaatacttcaacgaccgctccatcaaaaacctctacctcaacccaccagactggtactcttcctttggtggcaacaaacttgcattccacacatcagacgctgtcacagccatcaaccccgaagccaagtccctgcggacagccaagggtgatgaggtgtctttcgatgtatgcatccttgcgactggatccaacgccgcactgccgccattccttcccctcaagacgttccgccaaacaaagggctccttcgtgtaccgaacgattcaagacctggatgcgataatggagtacgttgttagcgcaccaaaaacccttggccgccgaatatccaaggttggtgtaatcggtggcggtgtccttggtcttgaagcagcaaagggtctccttgatctgggcgcattcaacgaagtggtcctaattgagggtgacaagtggctgctcagccgtcaactcgatgaagaaggcggtaagattgtcggggacaagatcaaggccatgggcgtgcaagtacatgcgggtgctcgagtgcaaagcttactgtgggatgacaagcagcggctcagcggccttgtcctccaaggcaaaggcaacggccagaagatcagtcttgacatgctcgtctttgctgtcggtgtccgcgctcgtgatgagctttgccgcaacacacccatcgctgtcggcaagagacccggcggcttcattgttgaccctcaactgcgcaccaatgtccctggaatttatgctattggtgattgcgccaattatcagggccagaactatggactcatcgcccccgggattgagatggccgaggttctcgccttcaacctaacaaaagaaccgcaccatcgtgcacgagagctgcagacgccggacctcagcacaaagctcaagctcatgggtgtagatgttgccgcctttggtgactattttgctgacaagggaatcatcagcaagccattaccaggagccgtccgcagagctgtggctaaggcgggcggcaccattactcaagacaacatcaagaccgaggtcaaggccgttacataccgcgatcccttcctcgacgtatacaagaaatacatcttcagtgccgacggcaagtacatccttggtggcatgatggttggggatgtcaaggattactccaagcttctgtcattgtaccgcaagggcgagccgatcgacaaatcgccttctgagttcttcggaggaaagaagagcgaagaagatgaagatgccgacttgccagatgatgcgcaggtctgcagctgccacaatgtcacaaagggcgaaatcacccagtgtgtcaaggacggtaagcggtcatttgacgaagtccaggccgccaccaagtgcagcactggatgcggaggctgcgagagccaagcgtcacgcatcttcgaccaggccctggctgcggcggggctcgacgtggcgaacattatttgcaaagacttcccttactcccgcaaagatctgatgaagattatcaagacgaaggagctcaaagacttccgagccattatggaggcggttgggaataagccgaacagcttcggctgtatgctgtgccggcctgccattgcttctctcctgagcgagatctacaacgatgatcgatacatactggctaccaagaaggaaaagcttccaccttggtctgccaggaaaccccatccacatctgtagcataccagccatgcttcatcaaggttctgctaaaggaccttcaagctctacttgcttacctgtacaacaataacccctctatagaatttccaagataccctttcttatttttctgtttgttcgtttttatctactttaggtttcgttttagagacgggcattgcgattaggatagacggagttggatactgctttcgtgtctttctgcgtcacgttgagagctctagaatatggtccatcgagggttttggaattctgagggtgcgaagatattagaattgcatagattagagaaatatcagttattcacatattcgttctagaaaaaatgcgaccaaagttgagctgtggtcttgtacctgaaattgaagtcattcactaaccaggtcataagctcaatcgttccgcacccttatttcagtaatcttacgactgatttagtcgtgttttggtttggcgcctacggaagcatccaaagatcggaccctacccacgccgcccgggttgaaagattatcattaaagcactccttcaagctgaaatcacatgccttgttgccatcatggcgaggaaacttgatctttttctgggtacttttcgtggtaacgggagtctgacaattgtcactgctactgtaggctcccaagactgggcgtctgtgtttaaaagacgcttcatgccttaacgtagcgtgcatggcttgggagactttgtcggctgtgattgccagcttcggttgattgtcgtgtttctaacgccagacttaggtcgcgtgaaaattccaggtaacttcacgattaagcagtccaagaacgacagcttgatctgatgaacgaaagagtgaaaagacattccgcattttttttggagggagtggaagagttaagaaacctgcactataaaatgcgccctcttcttattactcttattaaaaagccttctctaagcttatatatgagagaatgcataggctacaatcgtttaagttattgtttcgatttagatttagactagattaaaacctagggctcgagcagtcagcttggttatagctactcgagtcctgggctttaatctagtgactagaattatatagatgattagtgtggatctatataaatctgatcattatcaaccttgacaatcggaaaatccctagtagcgagtgggtttgtctccaacccactcaccgccccctcccctgcggatcatcatgagtccgtcaaattgtgttccgtgatatctcaacattgacccaaatccaaccactaatcgtacaaagaaacagtctatcatttcttttctgacctcggatttagatgaatatctaagacaccttgtcaagggccaaatcagcgaggatcgtccacattgtagtgcgtgtaataagcttcggctgtgtgaaagagggccattactcgttttaggacatttcttatgcctctttatccttcttcatttcttccttcttttgctatggctttgaacggctgattttctcctttcctcataggaatactcttcttgctttcttcctcatcagatggcagaatttgagtttttgcaaatttgcaagtgcttgcgatggttgtcaacatcaagttcctcattgccgcaatagcaagtgaagcgcatctcaggatccccctggcagctcctgatgtgtgccagatggtgatcccttcgagagattttcgatccacaggaacaacgatacctcggtccccaaggggtcaaatgtgtcttcgcggttttgcggtgtttgagtagcgctctctctgtggcgaaacctctttcatgacaagcaggaaggtcacatttaaaaggtctttcatgtctgtcttttatgtgtttcctgtaaataattagctgttatgttcgttgaaaatcaaacggatgacttactccagcgtctccttgtcccggtgactgaacgggcaagaagaacatcgaaagaagggctggcttgctatttgtacagattgcaaagaatagtctaatgtctgagatcctgaagaatgggatgatggagaatatgtagacgccggggaatcaaaacagcgctctcgaaattggcgttgctcctgccgaggcttctcatcttgtgcttggatttctttgcccaactccgtactcattgcttgggtgaatacagcgtgattggaaatgctgactggcgatattgctcgggtcataggattcaaaaactcttgcgtgatagcgagttctgaccacggcgaacttatcgtgaggggttcagcgtgagccccctggagcaatggtgaagtaagtgtggtagagaaatccggactggcttgaggtgatgacctagtctccttagcaaagaactcgagagagtcagccgggatgattgatggagagctgagagctaatcccggtcctgaagcaaggtggtgtgacgacgcaagtgggttgaaatcgcaaccgtgtgttggccatcctatgaatagagagccaccgatgtcttcatgtacttggtaagtgtcctcctgcaatgatttccactgtggatgaaagtcttcttgatatgagaatacagggctgttgtggtgttgagaaaccgaatgagaaggatattgtgagttaggctgcgaaggaagagaaatgaagggctcgagccaggtagggcatggcgtgttgcttgcaatgtcaaagcccactgaagaagtggaagctaagtttccgaaatcttgtgtccagcttgttatattgcacgcaacggagcccccagcaacgggaacaagtgcattacaatgagggcgacagttctgacggctgacccctggaacaaattgctttaggtgatgatcattttggctctctggaatattttaagccccgagtgttcggggcaggaatatccctgaaaagcttattcgttaagatgttttgttttgcgaggtgaattgcacacactcgatgtgtgagcgcaagaattcgaataacggatgccgaattggtattccagccttgtcgatcagtttggatttgcttcctacagtgtgtcaattgagaaacaatgttctggttcaattgacactgtcagagccaattctactacactagcaaaaacggagcgcgctcgcgctgattgctgtgcccaattgactatatagcctgtcactgacaccaacacaccccttctgcttggcaacgctatacaactgccaaacaggtcttatagcggacgatcttatcctcatggagttccgctagctggcgtctagttgatcaggctagatcttataccactacatttttgcggtctcaccccagaatcgaacgcagggctctgtgtgtttgttacgtcgcaggaattgctaccatgtcagagccaattctactacactagcaaaaacggagcgcgctcgcgctgattgctgtgcccaattgactatatagccgtcacgttggctacaggaaatgataatgattttgatatatcgaagtttaggtgtggcaagggactgaaatggtcaagaagtaggccttctgtacctagattaacttccatttttctcaatataaagctgaaaaaaaatgttgcatcgcggattttcctcaattcgagggatcggcacctggcgatatctcataatacgcaattccatgagttcattccgtcaactccattacactttgctgcgtttgtgtgtgatttttgtccctttattcttcttcttcttcctttttttttccctttttttttttccttcaagattgttattgaccgataaagttgttgggatttgaaatatgcacaaggtcacgtgaggtgaccagacatttttagtactacagcttctgtgctttcttttgtgggcccctataaagaatgacccctgctctgagtttaagctactttaggccgtagctgtttcgaccatgcccagcgttcattacggtcaccgttttcttatttaggaaggaggtctaaagtgtatcaaaaatcaatcttcgtaaataaaaattctaagagcaacggccgctttaaagagatatatcaggttccaaagatggagaccaggggatggcctttgagataccaatgctcccataatgtgaggacatgacgggatcgcgtgttttcgagtgggtatggtcgtatgtgacagatgaagctatcgtgaggaccatatacgctacgctatactccaccacaaagatgtataaaaaaaaacatacaacagcaggtattcgctggtcgtcaccgacccaactactaatccgcccctcgtccgtttaactaggagaaggacattactacgggttagctttgtatggcgctcaaaacactgtcatacatagtcacaaccgagctgtactgaaagatataaaccactcatcaaggtcgagttgcccgaggcgtataacgaagctgaacccaatcttaacccattccccctttctatacaggcaacacagtgccctgattgcatcggcgatgagtgactatcttgcttcaaagtagactaagtaccgaggtgggaacaattgtgcctacagtgttagcgcaaaatcttgatacctttggtaagcgataaggtacaaccaccaatgaataggttgagttgccacgcaacgcagacaggcggcgactgatacatggagtcgccctgccgctgatggggattacataagcgagagtatgactttggaggctcctcagcaggctactgagcttaaggtgcaagaagccattatgcgactgcacgagttctcttttctcagtgtgcgtcggaatgacgatggcgggcgtagctacaagatgcacaagcttgtgcaagaagctattcagtataggctgagggtaagaggccaaatgaggatgagcttaggggagccagtagggaaaggaagtcatttggagtgtgaagcatactattgcgggattgctttgcggatagtagacaagcttttcccggtatcagagggaaagccatggacacgatgcgaacagtatatgacacataccatacaggctggaaagtaggccgagttcagtgggatggaggttcgctcatcagaattactcagccgagtaacagatttgttgtatgctcagggacagtggagggagaaggaaaatatagataagagagtattggagctctggaggaatattctaggagagaagcatccggaggcgattaggagcatggcaaacctcgcgacgacataccattcgcagggccgacacaccgaggctgaacaattgaaggatcaagcacttaatcttcgacgggaggttcttggggagaagcatccggacacgatcaggagcatggcacacctcggggtgacataccattcgcagggccgatacgacgaggctgaagtgcttcgcaagtctgctctagatcttcgacgccagatccttggagaaaatcatccgcatacgactcaaagcgtcatgtacctcgcctccacacaggaatcgttacaacgcattcgagtctagtttagttcttggtggctatataggctgatccatctgggagagaggaggcagcgctgtagatatttatgggaggttatatacaatacaatacaatacaatttattacgcccggcggcttgaaccgaaagggcactaattactaatatacacatacatagcccaaattgtgtcctagtctcctaaagcccctaatctgtcctcgtcgtgctgatgtattctcatttactctctctttctacggattcccgtggttagtattattattagcaaactagcttggagcctattctccaagtgttcagtgtcctatctacggcggctgaagcggcgttcgcctttgctggcacggggtgagggcaagttaggttgggaagagtgggttagtgggggaagtaataggtccgggtctgtcttcatccgttaaattgcatcaaggcggcctgtggccaatgcaaaccggatagttgctcgcacagcctccatgtttggtgtccatttttggttgtcagaaggtgacttccctccaagatagaaggagatgttgcctcttcgggtatcggtgcattgaagcatctcagtacggtatgctgtccacttccggcagcggaagaggaaatgttcgactgtctctctcgcttgtccacaatcgcatctatccgatggcaccgctttgacgtgaaagagatatgcattcagcctcgctatgcccgtcctcagctgagagagtgcgcttgcttccttccatgatagctgatcatagagctgtctcgtgtgtttgccgggtagtgaggttatatacagtttagagcataaccagcttcctctttataaacacatactcaatgtcaatagagtctccacacagtgttatttactacaaaaatgcactgaatacatgatttccataacttgagacctggaactgtgagctagtctctttgttccactttcaaggacttagccgagaaacaggcatcctgatgtcgtggccaattcacactttacatcatcaggacatggcaccacggctatccgactttcaacgtaaaacactccaagatatcattataggtaagctagagggtaaagaaacaatcagagattcagatatagtatatgaagattgagaggcttcggaaatagagatagtaaaagtagggggcttgattagtctaatccctactgtttaccgtacggtctaatacaaagtattatgcacagtatcggatgtcgactgataatagtttgcatgatttctgctgaatgagcgtgtatacgtgatggttggcaagaaatggacactaggataataatggatgatgttctaagaggagttgcgggttgttaatgcctggataataaggcatagaaataatgttgctggtgggtaggggctctattcgcactagctacgcactgtgcatgcgccacggttggcccatttttggccatttttggccatttttggccattttcagcaaagtttcaatgctagattactgacgctgaacctgcacctgactgtacctaaaaataccttagtgtacattctccactattttacagtatgggaatgtccatatatagcgaacaaatatgcgtaattgatttattccctggtattgaatgcatgtaaatgcagcgactgaagagagatttaaatattctgggagggtgggaatttatgggagggccagaattgggctttgttagatcaactagtaccagtaccttcaggtacgagtctggtttgttacatgcctagaaataacccctgttaaaatagttatctaacaatacttgcgacacctatttcgccttttactgtatctcgaaggagtattaacatagtttggagcataaccagctgcctcattaaaaatatatactaaatataaactgactctctacacagtgtgatttactagcaaatgcactttatacaaagtttatatattttggagacttggaactaaagcagttctttgttccatgtttttggacttggcctagaaacaggcactcttatcttcgctcccttatagaataaaaaataagtggtatatatataggtaagtatatatatattatcactacttgcattcattctatagaatctagtagcacgttttatcattaatataccacaactactaagccttccaaatgaggttctatagcatatcgcctcttatttttctttaagagaaaaatatagatatctcggaacctcgaagaaatcatctcgtgccttctataatactgatctagaatgtaatgagatctggggtaggatttttaaggatacatcctggttagagctaatgagttcaagaggacttgtacctgctcttataggggttgatataccaatcttacctgaaatcgatgagggtgtcttaaaacatggggagaggcttccagttctattaatttgcatgccgcggaaaaaacaacctgcccggcagcgagttatagatagaagagctggcagaccttggcctcaaattaagatggataaagaactgctcatacgaactctgaaaccaaatgaagggtggcacaccacgtatgatgagctcgacttccgaggctttaggcttttggtgggagttgaaacccgcagaaggtttcatcacattgaagagcttcttcacgaaaaaaatgatgtgacctcggtgatatactttggcctaaatgataatcaaggatcaacagcggtatttaatgtaccagttcgaatggtcgagaataatgaggagtgggagcaggtaggattctcgataaaggataagaaaagagataaatttcttggccgttacattgaatatctttgagagatagtttgttacgaacaaaggcctcccctataggctgccgtagtcacgtgtggacccacctcaggattggagcgacaagagctgtgcgctcctatcgcgggaagcatcaggagcgagccagagcgattcgctcgtaacaccccaaggcagatatatacacatatatatatacactcatttcattagctagaacactcttttagacaattatcaatacatgttaggggtaatctgcatcctggttatagggtagctaaatcctgctattagtcagcagaagctagctactataagtagctggaaaccctctactagctagcttctagaaagaatcaagcatcttacaaccagaccacccaaacagcttatttagagcataacaatacatcttttagacagttatcaatacatcttttagacagttatcaatacatcttttagacagttatcaatacatcttttagacagttatcaatacagtcactaacgctttcattgaaactaactccttggcgctcgcatatctgcagtgactcacacagcaccaagacagttgaataatagagactttacagcagctataactctctgatagtggaagtaacgctctaactcatagggcttaattttgttacggttcagcacggataacccctatagctagctattacgcttacattgattgctacaatagcgattaatgcccaatcttttgcccagtggcgtagcggtatgagcgatcgttacaaatttactataactaagactttttaaccgctataacttagcaagtttaagagctagtaacttcaggttttcaatgataaatgtattttcgaactgttgagaggtgtaggttatctacttttcctctcatatatctgccggcctttatttacccctaaacccgccctagcagctttagtagctaatttcaattttccgcaaaattcattaatactagaaatctaaaaaatcgactcacaaccacctaaacctaagacgaatatatataacttttataagacccacttttatctgaaaggggcttaaaagacaagtatttgagtataaataactgatatcttatctcttaaactgaaagagttattccagtttcaaaagttactatagggtagtttggttatagggtagcgcaggtcccgggtaacctaatactcttttcccaggtttcctagctaacccctagggagggctataactagcctaaagcagctagcgctttataagagactagttgctaggcttgtctcttgcgttgcgattccttaattcaacaaagacaacctgatcgcccactcagaacaactctgattggttacatctctgacctaccctagacctccgtccagtgtaagtcacccaaccgtcacaccttactgcaaagcagtgggaaatatacactagggtatttttattcctagaaataaatataaagacaatagagcggaagctggttatgctccaaattatattaactagatatcttatccttataaagataaacagactttgtatttatattttttatatcctagctcttatctttaaagtatatagtagatatttatagccttcttgtgacggttgggtaacttacactggacaggggtctagggtaagttggggttaaaccaatcagatgttgttctgagtggcgcgatcaggttgtcgtaggctgtgcaatgcgagtcactgtcaatgtgcgagtattgtggagctagtaacaatagaggcgtagacaattgtattgataactgtctaaaggagtgtttctgtctaagaaatgaatgcgtatatataccaatggatcattgaggcttggcaatgatctgtgttcgtggatcatgaggatcattgtgagatccgaatgatccagttttgattggtagcgagaagtggggtcccacacgtgatctgtgcgtaggagtgaaattcgtaacacttctattataattttttttttaaatattttttaatattcttaactataagtttactaaactaagattatttaattaaagcctataaagaagaatataaactagaaaaaatactataaaagtttatattttaactaaaaagatatatagatgtgaaaattcaagactcttatttaatatataaggaagatattagtcctttagaaataaagattatagaagatatattactttaaaaataggtttagattgctgaaatacttccctatagagatatatcaaagactatagctaagaataaagaaattaccgtcattacatatagctctattagcctttaaaaagtcctgatcattaaaaaaagaggaacaaataaaggtatactatatgcgaagcctcgtggacttatctatttccaagccagttcgcactgcatttaccaaacggagtccatgaagattgttggcgattattacctgtaactcaattggtaaagagaggattgagtttaatgtcttttgggctataagttgatgctgagtagcctttttttcaaattattagaatgtactaattgtattgaagcagggataaaaggtccgggttccgcaagtcatgccgctcagcggcatagttaaaaggagctgtttttcgcagcctagatacacaacacatgctttttccttcattcaattgagacactaacttgtgaccgacgagtggcgtgactgacgggtcgcgaagcctctgttcaattcaagccggctgtggcctcaagaggcgctgcgacgagcgtttcaaatgcttccttcgtgagagatccttctcttctcaatccgttcaatcgctcgagacgaggaaggtcttcgtacgatgaatcacaatgcgggtgatgaagctgtcaactaacgcgataaccgctgtgtgccacatacccttgcgttgtggttgtgggtgttgtgtgtgtgtacagcttcctctctcgccgcatcaatatattagaagtataatctactactagagctatagtagctataaatagttattttactattactagaaataggcctcttagcctctttagctcgattattactattaatcctttagaagctactattataataaattctttatacttaagcttagtatctataataatcctaagaatcttaatatagtattttagttagactatctatcccttaattataaatagtttagagttagattcatagttctttttagtaaagtatataattactattttacttatcttaaatattatactactccttctttcttaagctaatatatctataattattaatttaatcttcttatagttactatatatagttaggcctataacccaggctataaaattatctataaatataatagcccccttattgctgttaatctactgctatactaaatctatattaaagaaaaggattaggattagggatagaggaaatccttagagaaggccagcttatagtagttattgaatctctgatgaagtgctgttaatctgaattataaccgtgcggtaggagaaaaatgcttccacccattgaaggagcttctcagggataccgcgtgctttcattctctggagaaggctttccttgcataaacccaatgacccaaattagggacatagtcctatgctctcaagatagagtaatccagaactcaattccgattcgcctccgatgctgttcctccagaagcctcagctgcttcatgctgattaattgtacttcttacccgcccgtcaatagtggcaatggtctcgatagtcgcaaggacctacgggaccctataagccacgttaccaatagctcatgcataacgccacaagaacatacacctatgcctagcagcccggcagccccgtcgtcatattgtcgtatcagtgtaacagttttcctatactgctgaagtgtggaagagaattacccgcgcttcaaaatcgtcatacagaggtatgtggcagcggttcgtgtcccgaatatcaaaccagctttctggtaaacccttgtcttctgttacttatgtgggccagattacctgttgccctatacctgacgctcgcaatattcctctgattctcagttgtatgctagaagtgacaactaactaactacttgtcctaatttctcacaaaacaagagcgacttaccagtcacaataatggaaaatctttcgagcaacgtcactagtacccagtcctatctcaattcctgccgccaacgccttaccacgtccaatgccagcgctaagaagacagtcggcgccgaggttacaggcattcattcctcactaaaggacagcttcgccaaggtccagcatactacgtcgcagatgcggtcctttctcttgcagatcgaggatacagttaatgccgaaacaacggttgatatggccccacaaatatcctggctgagcaggtcccttgtcagcatcgttgcctccctcggtggtgcagaggcgtcggcgggccgcgcactgatgtgcaccacacagcacacataccacgtgctggacatagggcaagagatgaagtctgcgagcagccggctgaacgagttacagtcacaggtcatggagatgttaagccaggctgagagctcccttggctttagccagcaggttctcaagcagactgaggcgaatgtacgcgctaaagagaaggaaattcaagtcatgacgtgtgagacgaataataagagaagcagtaagtcgcagttggaatgcaagatctcacaaaagaacacacagattgcggacatagagagacatcgcaataacaagaaagacgccgttggcgcggggcttgtatgtattttcacaccctgaagcacggtgatgacagtttattaattacggaaagaatagattttgacagctatcggtatcgtaggggcgcctttcaccgccggggcatcgttgccactggcggccgcgggagctggtcttgcagggtgagctgaagcacctcgaagcgcttctaacatcagaatctaactcacaaatcaagttacaagggcgttcgtgtaaaagatcttaaggaagaggcgaatgcactccgatctagcttgcacatccttacaaacgagatctcacaacgcgaccaagtaatcgcgaacctcgaacaagagaaacgcaagctgcaggctctagtctcccggtaccaggacgacatatcatctcgcagactgaagaacaatggctaccaaaaggaaatcttcgaggccaaccgcgtgcggaaagagatcgcaaagttgaaagacgttgcggagtccaccgcctccaacgtcaaagacactaatcgcgagctacagaagattaaacagagcctggacgaattcagctgcctagtccaagataaatctacagatgtctcgacctcagccggcgttgtagaattcattaccggggtgatctggccgcagtctgtgtcgaccaacgctcggcgcgtaagggagttcaggcagtggaaagagataatgcagcaggtttccgagacactcgagacaattgctacacagattccgttactgctgccgagccgaaagatagaattcctagatttcaagccctgggatgctactatgacttcggatgtggggattaacgacgagattccggtcatgcgttgcttcgagactgcctgaaggataatgcatggttttttagtcgtattaatgtaatttcaactaatttaaccaaattttaaaatcatgacctatattcaccgtgcacgacaaagaaaaaaccgacacttgtcgatgttaatggatttaccgcttctcccaaaagtacaacatgatatccattactaggctggtctacaaacggacctctctcctaacgccgggtagcaataatccagctgggtaaggtatacatatccccctgaaccgtactcctccatttaccttacacggatttagctcgattaacgccaactctctataagaagtaacactgtcacttccaaattttactcattctaaaacgtcacaatgatccaaaatcggctgctttgaatatatagaagctctcagtagcttgagtattaaacgcccccattccattcatggccaataatacgggccctttgcatcgcatgataccctactagattgttctagatttgatcttaataaaggcacctaagtttcaagtctacttatatacacgccatttcatcgctctaagtttgtggtgtgcatgttgaattgccaatttgccgccactaaagtagcctttgcattagcatttgaatgctatttttaagccatcaccaccaagctcaagcttccagcctctagccgtcggccccgcgacgttgcagcgcattggtgcaagattatacgaaagggtgttgaaaccgtggctcggcatattcttcaatagtcacaagatactgcagctgataaaacgctactgagaatagtaaaatttgaagataagaacaactactcaataactaggtggcttcatactttatttcccctcatgaagctctaccctcccgacgcatcatttgcgacagctttctgtcagctgcttgttcattccatcaactatggtctagaacacgtttgatgtagtcagaatgcgtgaatattgacgactgctgagccggtgctgccggtggcactgggctcgaagctagacttgggtttttttcgcgtaagtggacatgtgataacttgagtggtttagaagatgaggataaggggtcaacgaggcgagctgtttcaaagcaatggcttgagtttggagtgaaaggaacatacggatataaaagccccgacctactttcaccgtaccagatatcaggttttcagacctgagatcaagcatcttgataattccttttactgtttaaaatgaacgaaacaaaaaattccaccgtcggtaaagatgatgacgggccgcgagcggcattcggtgaggacttgggtggcgaacccagactgtccgatcctgttgacaagaaagcccagaagcgagctaactatgctcttgctcttcaaacatcctgtcgagatgttcttcattctatcaaagcaagcgaccttcttgtcaacagcgattgggcaaaacctcttacacaggccccgaacgcgatctctatcatggctttatgcttgaagacggctgccgcccgagaagttgcgggcattgaagtgtctaatacgacgatcacagatgatactgggaataaactcggagagcttccgtaagttgggagtatcccttattataaatatctgtttttggctaagtggaggttagatcgaagttcttttatacaaacctgcagcattgcgctgacattggtcggcttgccttccaggacgctcagaagcgtatgaaccaacttcaaagcgacgcgcggagcatgatcgctcaggagggcattatcagctatattattgatcttcttgatgatctggaagatgctcgagataatctgcctggagctatgagaagattggcaaataatgcagagcgtttcaagaacgacgcgcgtaccatagctgagaagtttgagtactgggaaaaggtgattatgcatctgcacaagacctcaatggataagaaaggtatggcctagatacagttagtgtctcatggttgttgttatactgacataccattagcggaaaggggtggcctcgtaggacagaatacgaatgaggttaacagggcagatgctgagagactcaagggtgagcaagatgagatagacgcgaaaagggctgttgaagagcagcagaaactgttgcaaatggcacagaaacagattcaaaaggctcaacgagagctagacgacatccttgaccagccgtccattcaggatccgtctgcatgggaggacttcttattagcgagggaacttgtcccagaccgaccagcaccaagtcgaggtacgtacaggaaatatacaaggggacatggtaaggtgcttacccagcatgctaggagagaaagctattttcactgtagctagggagttcattatgggcacgagcgacaaagagttagctgcagagagggagcaccataaagatcatgcggacgccattacgaaagagagacagagtttcattgataaagctgcggagcagcgcgaaagccaaaggcggatggcccagtcccgtctggaagacgcacgcgaaaacgaggctaggcgctgggaagagctgactaaacagcaagagaagctctcgactagttactataacctcacaaaggccaggcacgacttggtgaagactcatgctgaacttgagcgtctgggctccgagaagattgagttggtaagttttcaatctctgttacttgtctccgtttgctgtagtacatactaagagaagcaataggagcaaataatacagattttggaggagtccatgcgtcgcttgacggagctcaagaaggaagtggcagagatggcaactttcttcggcagcgtgcatactgtgatcaccacgactgtagatgagcacctgcaaagcttcttgaatccaatccggagggtggtagagaaaggagagacagtcgataaaatccgggaggggagcaagaagaatctacttgcaaatgcgttcgaactacaaggtcgattctcagctacggcagacgtggccagtatgtacgtgttggtgtcaaacaagtacatcaagccaggcatcgatcgaatggagcaactggccgctatgaacgatgccgacttcgagaggggcaaagttgatttcaggcagtggtgtatcgatgccgctgaggatattgcgcggatcactgagggggaacagccgaagatggcaaaaaatatgtcaaggagtgtggagacgcttaggctaagggctattgaagctgctggctgtgatactgatactgctggctactaatagaagccttcttgttatctgtggcgaggaggaaagtatatgtaggagggctaagcttgactacctagtatatttgaaaggttttggtagcttttattaacttttgtaaggagcttagagttatgatttttcggtcgcagccctttgatgaaccatctcgaatcagtcaactccgcggattatctcttgtctagctgtgaacaaatacgggagcgagcagctactctaacttttagctacaagtatactcaccctgataggaattttgaaatctatgcattgcattgtgaaacttaaaaagagtaacgtgaatgttggtttcggccttgttaggattgactgtgcaagtttggattcaaccaaaagttctttcaacactatttgattgtatgggatgcatgtccctctgctttgttcagtggtattggaaagaaatatcatttgttgaaatgcggggtgcccggcctccataatcgaactaagtgtctccaagcatcttgtgcagaagacctatatatattccaggtcattggaattccttgtggtaaaagctccttgaaacctgcagttcgagggtctaccccctttgtttccaagtagttgccttggatcatcacgacttgactgacaatgctgtaatctcgaaatccgggtatcattctcccgtaatgaaccatgcccatgccatgaataacccaaccatgccaatgcgcgaattcacggtcaacgttcattttttctcgaacccacctctgcacggcagaatgcatgtatgtggcgtctggtgtgttttttaataggaaaccgaggtcttccaaggacgacaatgctgtgactaacttatggtcatttctgaaagtcttaagttccgttacatgttcaatcaaagtcttgagaagtgagcggtttaccacgagatcgagaaacgatagagaacgaagaagtgaccatctatcaggctcagatgacttcatctcgtccaacagataagatatgacggggggtaaaccatgatcatttgtagcatacttgctcagtgatgtcagataatcttgggtgttgcctttgcccttgcaatgacgagatgctatgttgaatagaagtggcagattcctcatgtcttcgcggtttaaatcatcgccgttgaggatattctgttgagctggaagaatatcttcgttatcagtccatccgggatagtcgagatgcaagcctttttcaaacccaagatcaagtttgtcgcggtacttgagatcagaagtggtgataatgattttgccgccggaacctgccgggagcatgttcctaatgggctcgaggtagtcccagggcccgcccccgtcaaagacaattagccagtcgcttctcctctcaaaataagctttgacagtgttggttgcttctgtgtaactctgggtgtttggtgtcagtcttagggctttatgaagtcttcggtattcagcctcaatcctaaaggcattagtcgcgacaatccagaatattccatttggatattccttatgatgccgccgacaatactccaagactagggtagatttaccgcagccctgttctccgtgaaccaccgccacagtatgagaatccccgggtctgatagacatcaaatcagtgagcttttccagttctgcagtgcgtccaatcatatcctgctcagactctctgttgaatggagtgaaccataaggggtctcgacctttgatctgggtgtcagtagagttttccaccctgaataatataattttggctgcgatatggagcaaagaacccattatttgcatacttaatagatattttcaatacagtttgaagagcagagggtaactgcagccacaataccaatagcacctgggtagtcacgtaccaagagatatttgcatgtaggtcaggatctccttagcgagacctgcagctgctgcagctgcatagtgctgccagtcatcattcttgtgcgagtcggagtaatcgcaaatgccacgcaccactatgcagttgtaatcacccatgagtccggccgcttccatctcaaaacaaattgcaccgtccgcactgcgactaagacggtcgcgtttggtcgcgttctttatcacgctgtcctctgatgcgataagtccataaaatacaactggactgtttggaaatgctcctaatcgtggacttcgaggtattgcttgggtgatgtcgcagttcgagcatgaaggttgacctagaatatgctcataggtagatttaaatagaatatctctctctggtgatggtcgttggtattcaacaagctgtgggaactgctgtaacatagtctcaatgaactgtgggattttgttccccagggttctttgctccatcctcatttgtgtggctgcatgcaaccattctggcggcactgggcatagataacctcttcgctcgaatccagtttgcgtctcagctcccaaatcatattggacgacgccgcctgaggttccacttggtgcgctcacaaccacatctccaagacgaatatctttaccctcccttgggacgcctcctccaatgcctacgagaagtcgcagcctgatggacttgaatgtttgttccatacgagcagcgacagtcgccgcggagactgtgcctgtggtgcccatcggtaaggacgcgataaccactttgtgcccactgagttttcccagaatgtactgattcctgtcgtttctagtgccgtgtacccttccgtgtttttcatccagcatataccgtgcagcactcatttccctctctagtgggcatatcagagcaactgtatactcgtcagggttaagtgatctctcaggcacattggccattgcgtatactagtttggtggcaagtgttgtaaatagtctcgagtttcaagttgagtatggggagaagttgaagctatatgtattgaggaagataggtacatttaccggataagattgcgttgtgataaataagaataaattattatactcactcaaaaccaccgtcatgggtttatttactgtgctcgcactttatataaagttggtcaaactgtgaaaaaattcatctgccttggttataagaaatcgtatgaactgaatacaggtagtttatggcacatagctcaatagagttttcaaagtttcattttgtcccacctggatctttttggggcatgatactgaaatgaacggcgttagagtagtgaaagcttcacgatactttctggaagccaagtgcctctgaagcttgaaaatgtttcgattttgacccacattccaattgcagctctctatctctatcacattccccagttctgaatatcctgctatctcatcttatagggatggatagaagctaatttcattcacctctatagctactgttcttagcttcaatttaagccttgtaataacgtcacaagcccgatacccaacatccctaacataagtacccaatacattagtgtaaggctttcgataaatagtaggtgatacatatctgctaagtaatttttgaggactttcagtaataaggttttactgctctcgtctccctgattccaacgtgcaattcattcgtggcgttgtggtttgtccatggcggtgcaattcacacacggcgttgtgctctagtcatggcgttatgctctacccaggtacaaaattataattcgcccttagcattataagttcctaggaatgtcgcttggccgtctacgccaaagtttgatgattggtaatatcttccaaatgtttcgctgcttgtatgaccagcatttcccattctcgtagcttccgaatagtattttcctatattttaaccgctgtcagccagcttataagcctcagaaagtagacaagaacttacctgttacattcatttggcgtgccctccagtcgtgctgcgtaagtggaggatatacacccgcccgaatgcctgtgttcttcatccgtttaccaaagtaattggcagtctcaatctcgccacctttcgtagttgattatctgttgaagaagggcttttcaagaaattctcgtttccacgggatgtgaccagaaccagaatggatgcgtggcattgccgagagaaggctccaaccatgatgagcttgggacacaaagaacagaaatgaattatagcaaagcattccaggtttggctcttcgaccttgtgcgaggctgtgcttaggcctagccgcatcaaacttagctagagatattcaatcaacgagggggcagcttggaatttacctcttgctcacaggtcgatgtgacatgttctttgcatcgttggtgagctgcatagcaagttctggctcattatcttcgtttcgaaaacagatacacataacatccttaatccaattgtgttagcgttccgtcacccacctttcatagggctccataatgagtacctggtagaataaacctctttctccatcagctggatcacgagcgattgattgtataaattcaccaatacgtgcagtgcagaacacattgacaaggaatacagcccaatcatccagccttgtggaaggcatttggtataaatagaaatcttctccccacaacagctctgtatacatctgcagatggccatcgtgtgggaatctcctgaccctcttttccaacaagagtttcaacttctcttttagtggtcctttgataaactggacttataagatagctattaactttgaatacagggagacataaacactcaccacaagtatggaatcagttaggtctcttggaatagcagtatgcgctcttctccatgctgagcagaagcatctgaagtagtttcggaccgtctcaacacaaggggcaaggtcatcaatgccctctagcgcgcatgcctctaccaagacaaacctcttcagagttttttggtcgtaaggtgttacctgagttggttgcttctcagcaaagctacattggcttgttagagatagctctcctgatccgtgaaagacttcgatacttactcataccacgcatttaaccgtgcttggtatgctctttccgttgcaggctctacaggcggtagacgtttttcaccagtgagaataccaatacgacgggtgaatcctttcgtctttgcctattccacaacattcttcttctttctcgccataataaaacaaaaaatattgaatatagatatagaataaaatgtagaatgagagaaattttctgtttagaataagaaatggttaaggatgttattttcactgcttgaagagaagctcgagtcttatatagagatcatctcccctgcaatggatcgtattcctagtcttgtaactactcctgcccttcaatatgcctggcataaactgatccaacacctcacagatgtatcttgtgtataggtacatacatccaatgaggccaagtttgaggaccatcatcagcaggggtagactgagtggtcccagttcttgggactgtgccccagttcctggactgcgactgagctgactgagctgtggctgagcgaagccctgagcgaccctgagcgaccctgagcatggctgagccgaagttgagccggtgcggttctgcttatgtcatgagccaacgcagactaacctaatatggaaaatggagacgtttgtttttcaggaatgactacaatcattaaacaggatgttgcgtgccaactcgagctcttggaggaacattatgaatttttaatgttcacatatcacccaatagctaataccgcacttcgatgccttccagccaagtatcttatggctggacttttgtggaagcatggaattcactccttcttggaaatactgcgtgtcaggcagcctgattctcatgagcatatgcttacctttatccatcagacatatactggctagaactattgtatgagtctggtctgttcctatgcttgaggttatctggcttgattttttaggagatatttccagcagcgagtcacctgaatattccgcaaatcaactacgactcacatgagttcgaaactaacacaagcctggcatggcgctactggactattgcggagcgttccggttacgcatcagaaaccgaagcgcgaaacgccttacatgccgcaacgcgggggctttgtgcactctccaatccagacgcgctcccgatgtttaccaccaggatctaacgcagcggccaaacgatgacagcagcgatgagaatggggatagcgacgagagcccatgcccaacactagattcagcatacttagcacttggtcagctaactttgttgtacaaaggaacaagcctatccactggctgtgaggagatctccagcaagcttccagcatacccagaatgccataccttcatcaaaatggctggcccattcggatcagaaggtgaagagcagtctaggcgcacacgcgaggcgattagctctatagcccttaaactaaatagaagggctgaatactgaatagagttctctcttgttccacacaaatcctgatggtgccactgacgtactaatgagaacgccataatccacacctgcaaccaatgtcaccgtgcatgaccgcgctcaaagcccgatgtatgacttcgactcccgcaggccctcgctctctatgtgtgaatatcgccctcggctgcttcaattgcttggcgacgcgacccaaaactcatctcccatcaatcatactcgctccagccccatcctcccgagactttctcatagatggctgcctcggtattggcattcaacggtaagccaaatgctgccaattatttttcgtaggcaagcctgactgtgttagggaaatcgtggcaaccaggcatgattgaccttcgaacaacgaaggccctccaccaagtatcctacatgtaagccccacgaatcgagccacttagtcggtagaaactgacaaactattccagttttctagaaaagagaagctttctagataatacaaacatttacaagagttgttcagatgacgatcgccgccacatgttagcaccattcaaggtcccagaccttatcagaagtcaattatgtactgctcttaatggatatttcggctgccagagctcgctcaagcatacacctggcgcttccgatcagctcagcactctcagtaagcttctatttcccttattttgtagcatgaggagggattcttactcgctctacgcgcatacaggcacgtggacccaaatcctcacgaagaagatcttaaacaacagcgatcagacggtagccggtggcaaggactacagatggtatgagatggcattcttcacgcgatggactgacgcaggcgttaaccagatactttgcatcgacactccgcctacattgcgtgaggaacttaccaaagttctcgctgcgtcaccgacccttgagctgcaagatccttttgcgatgttccgaccgctccttgacgaggttctcaaattgtgcgacgagaatacgtggcgagtagcaaaggaagttcgaagaattgagaaagtacgaaacctccaaaccccccctgcccgcaccgaagttaaccccattgtagaggagaagcgagaggcccgactttgagcagctttgcaatttgggccggcacgctcgccaccttgtggaggttgaggctgtcgcaattgagacgatggaacggctcatggcccggcaggagatgaacttcaagatcctgccccgcaccatcaccaagacgtatcagagccaggcaaaggaacgcctggaatttcagtcacagattatgaaaagcctcaagtggcgagcgcaagcttcctctgagagacttgatggtgaaatcaacctggtaggctaagaaagcgggagttggaagaacctatgtccgttaactgcgacggtaggcgtacaacatgctcgcaagtatagacaatcagattatgaggtccataacactgctgacgatgatattcttgccggccacgtttatatcagtaagttccatgatgggaagacctggtgcggaccatgtcacaggttgattaggtactgacatccaccaggcgctgttcagcaccacatttttctctttcggtaaggatgggttgaaattctctcgccaattttggatatattgggtcgccgtcatccctctgaccgttattgtggtggcttcttggtggttctggcttggcggttcctacaaagccatgcgatctaagctattacatgattcccatcgttaagtagttgtaaattgtagtcggcttatatttctagcgttactatgtagcctttcgcgtctccgcattggaacgcagaagctcgttctcgttgcttgaaggcagccacaggaccgttaacatatttatgtcttcccgcagctctgcgattgaattagaggttaagttcggctctttaataggtgcttgcccctatctttgatgaaggcacagcttgaggctggaaaagttttggagaatgctaccgcacgtggctcacggaattttgagtttgagtttgaaaggcagcagtggaggccagatgcaaagactgactttgattatgctacagttgaggcgatgcttcgggtagagtttgtatgagattgggagttatgatttattgttgaaactggtactttcaatatcacatgtatttctttggcaacttcggtggctggcgctgatgctcgtcgtcctcatcattatcctcaccaccattcccatcgtcaccaccgtcgttgtgatcttcggagcggggacggtcctagcgacccttcttaataccaagtttagacaatattctgtatagacgccgtatcctaattctcaagtcagaatagatatatttcaaataagaggaagtaatactttatatctgtttgaagacctaacttatttttaaaacctcgagaagttcaagggctgtcatccgttgatacatctcttgaacttcacttgtgttttcgctgacataatttagcaagcaaccatattctgaccgggcattggctttagccataatagccataagggaagaagcagccacaatagctttgtttttgcaactcttggtacgggtgtgtcgagagtaattttggccatttttgagccctcgcccacatctcggacatcgatatcgttcctcagcggggtggcaggaatgattgttgagcgtgttaagacgcgaatatctgttcgcacagcgagggcattggtacagcgctttcctgccatggtaattttccatatgttttcggtagacattatctccataaaagatgtcatcgcacatcggacaagttaaagttatatccctaggaggtagtcctctcgtaatcccccgataacttaacatgtttcgaaggtcctttggtctataattcgagccagtctaatacatgaacaatagaaggaaggcataccttaaagtttggaatttgaactgagatattaagaatctaagtaatgccaacgatccttcctctgaaaacatgtttacgatttcatcatggtttgtagatagaagttctctgaagcgtttgcgttcttttcttcgagaaacggaaaggggagcactgggagacgtgatattgggtgacctggtggtgtactcttctacaaatggcgtctggcgccctgcagaagagacaaccggaacatgctttgttcgatatctttcgcccgtctctgtgcgctcaaacgagtgatctggctgctggtccagccgtgcgtgatgtttcagctggatgtcaattcgtcgttgctgatgaagcgggatattgttatgccattgtcttgtctgttggcactcgttctgcccattggcaagaggtagaggggccaggtgcggggaggagggttgcttttgttgatgatgctgctgagggaactggatctgtgtgcatgtgagcaaacgcggcggtatttgctcttcctgctcccaggtcaccgggtgttcttggaggccgacgaggggctcagcttctgttacttgctgcctatgcgcttgtgccgttgcttcttgctgcggctgctgctgcaagtctgttctcctaataccgtcccaattactccccccatcattgataccaatgatttgtactcggtgtccacgattatatgagcttattatatcggcattaagtcggtcgggccgctgaggcggcggaatcacccccgtaaacaatttccgggcttcaacattgtcttctcggctgatgttcctagacagagtcgcacaagtctcatcgatcttagatagaggctgttcctcactcgagtgcttatgatgttggccccccaaattatcgctggtggtttcgctccaaatatcaaacgaagcaatagggagcaaggccgctgtcaggaaaggagcagcaccagcagaggagccggcgcacacggtcgaactagagacatgagcagagctggctattgcaatactagcaaaatcaactggtatgttggcgtgttgttttggtcgacatcttggcctatatcgttactaatgatgctgacaactgcactttggtattaacttactgctcttccctgtctcgcactccagagctgggtagtttcatggcaatggatggtgctgtgagcaaaaagccgtgatattgtcaagattgttaggggcttgctgggggaaattgaagtccgactagatcgaggagatagagatagagcgacatctttattcataagtaagtgattttttgctttttaccaatcttacggtagctcttggatggccatctgaaccatgtgaatcgcatgcacacacccgcaccatcagcactggcgtcgttgcgtgtccacctatgtacctctactcgacatcttgccttgatgtggatatttcggcctaagacacatacttcagctgtgtcccacttcccggggtcggacgtcgtagacacaccccccttaacataggccgactgcagccctcgaccagggcccccatgtattggatcatgtacgtgactcggatgtgccttagggccaatgctctctttacctaatacaattaagttacgatcaaagccaagtcaaaacgagcaagcccttgtctctcaattctctcaacttctttttgaacaagccaacttgcagcgtccgcccgttacacctgagttctaccataatggaaaatcacccagaggacactgaggctggaagcatgaatccatacacttgtctccaaaatccgattccaacactccacgaacgactaagtgcatcaataaaccgctatcatcgattttctatagcgtgtcttggaagccgggcattttgggctggctttgtcagtggtattataataccactatatctcctccttctggcctacctttttggcatcgacccaagaagcagttgtccattgcttccttgggacgggtttctatgacccaggaccaaatcttgttcgatttgacctagggagatatgtggaagctgtatgggcacgtacatgtacggagttacataggtttacaccatagaaggacccagaaagggcgatgtgtacgaataggtctgaccatgtgaggcaaataatatattaactgaatcagagaatgtatctaaagaaaaatccaaagacggtgaagaggcgtaggtgaccgcggaccaggaaggcttcatgttgtcatcgatttaacccgggaaggaccaaggttggtaatcagattgttctctactcagaacagggaccatccaggaaccacgctatgcagatattctctgaccttctgaacaagaagaagcatcaactccactctcctggataggagcctctgggcgtggagaggcgtagagaaggacattcggatagtgtggcgctgatactttctgaagctaaagacacattatctcgaaagacaaagagggaccgagaacattgagaggtctaaggccccggtggagtgcccgactgcgttcccgacaaaacaacacagtatggctgtatattgaaagtcgtgtgagaatctgagaccaagtacgttggaatcttgggacggtctcatagaaagtcaacatgaagctatatgacatgcggagaaacgtgtctaggaattcgtaggattctggaaggccccgaataagcatgtcaatgtagcccaagatgctgactctccataatcgagtttccattgactgtctaatggcaagatttcgaagcgcttggtctgccatcgggtgctgggtagcggaaaagaaattataatgctcgccgagaagtacgtagtgaagattaataatagccctccattgatcattattgaatatgagagtgccttgcgagttttcatggtagaagttggcagccttggcttcaagcttgaggagaccgccaagtatgccatgggcctcgaccgcgagttttttagaagggattggtaccgtcattagttgggggtcaatagcctcacgtggataaagtttggtatgttcctttaattctctgacccgaatatcgtacggatcatcagatagctttttgttgattggcttgcgcttcttcgtctcgtggcgtggggcttcggtaatgccatactcaagtggttcactcttgacatcctcaaggtatacctggcattttttattaacttcgatcaggtggtcgttgtcctatttatattagctagtgtgctttgttggctgctatagaagatttactgtggatagactcttgacatccttaaggtatgccgggcattttgtattaacttcgatctggtggtcgtcctattcatattagttagtgtgccttgttggccgctacccatagatgatctaccgtggatagccagtgcctctttctgagacttcgcactagcatgaatagtgcaccaaatccgatcggaagacacattgcaaaccaaaagagggaaccatgcttctcaagttgatttgtgatgaagcagagtgcttgctcatcgagtggtcgtgatgcctgtatattgacaacagaaggaccgccgatgccagtcacacagcgggggcgacttgccgaattgagggtatcgctattcagtaaaggagccattatcttcaaataaagtggtagggacgagtagtaagtgatttaggagggatgaaaatcgaaagagaggatgtggcataaaaataagtagtgggaagctacaaacagcaggcttcgttgggcagcaataaacccgtcaggcatttcatagatctcgtagatttgctcaacccttgccttcatcccttcattgattcttcttcttctcggaaagcctatgctttgtcggagtgacccccagactaagtgaagacattctgtgattttgcccctcgcttcttccaagctggtccttcatgtgaggcatttgcgttgacgcattgctgcctaataagcggggttattgccttgacgcttgatcggaacggatcacctcgagcatgcagtgactaaatcagcctgcgtcgaaggttgggctaatcatcgcgaggagctccgcatctccttcaccttcccttcgaaaaagatccttaccgaggactactgccgacgatgtccaacccccatgactacacggtcggctggatctgcgcgattaacactgagcatgttgctgcgcaaacctttctcgacgaagagcacgaaggccctgagtttgtgtccacaaacgacaacaatgactacacattgggcaagattgggaaacacaatgtcgtcattgccgtccttccccacagcgagtacggcatatcgtccgccgctagcgtcgcgagagacatgctctccagtttctccaacgtcagaatcggcttgatggtcggcattggcggcggtgcaccgagttgcaagcatgacatccggcttggggatgtcgtggtgagcgcttctggcaatggtaagggcggcgtgttccagtatgacttcggcaaggccatgcagggccaggagttccaagagacgggattcttgaatcggccgcccacggttttgcgagcagcggtgaacggactcatgacgcagtacaagcgcaaagggcaccagattgatacatctatcaacaacatcttgatgcaaaacccgagactcaaaagggaattcaagcgacccgagtcaagtaccgatcgactatatcagcctgggatagtccatcggccagataatcagtccacttgtgcgatagcttgtggtgaagacccattggctttgatagcgaggcccgatcggactgaagacgacgacaatccgtcgatccactatggcctaatcgcttcagcaaataggctaatgaaggacgctttgattcgagatgcgcttgcgaagaagcatgacgtcctctgcttcgaaatggaagctgccggtttgatgaaccactttccctgtctggtcatccgtggcatctgcgactattccgacacgcacaagaacaaagagtggcaagggtatgcagcgatgacagctgcggcctatgcaaaagacttgctatgcaagatcgcactaagcagagtagaaaatgagaagaaaatcagcgaccttgttcagagtggttagtactttcacatttatttattataataatattttttatattccagtagaagtactaatacctaaaaagtcagtaaaaaggtggaagatttgcaacacgataaccatctcaacaagattagaaactggctagcaccacctgacccatccacgaatctaaatcaagcccggagcctgcaccatcaagaaggcaccggccagtggttcctaaatagcaatgcatattcgggatggaaaaaggagaaaaactgttttctatggcttaatggtatccccgggtgcggcaagaccgtcctcagttctaccatcattacagatcttgaccctaccaaccataatcccaaagttctatacttcttctttaatttcaacgatgttgagaaaaggtcgctggagaaagccatcctttcgcttatttttcagctctattccaagcacatcattcttcgcagcgaagttgatgcagtctattctagctttggaaatggaacgaggcagccagatgccccagttctagagcagctcttgcgacggatgatgcataagtctgaggagatttatattatccttgatgcactggatgaatctgagagacatagcggttcatactcatcgatatcattgcttgattggattaagggtcttcacgatgaatcaactaacatacacatactcgtcactagtcggcccgagcagtatatcatggcttctttcaacggctgggcccatactgacgaaatcattcgactccaaagtgagttggtgagtgacgatatcactgcctacacgaaggccagagttggcgaaatgcggaggtggaagaaacggccggatatccaagtagagattgaaattacccttctacaaaaggcggatggaatgtatgtggtcctctctggcggatgtttcatctcttacgtttccaattcttctctctgattcagcagctaaatttgttataggtttcgctgggtctcgtgccaatttgacacattggagcaatgtctagacccgccctccgtgcgaagagaactacaaaacctgcctgagacgctagatgcgacatatgcacaaattttgcgacggatacatccgaatcaactaagcacggcgaagcgccttctacaatttttgacgtacagcgaacggcctctgaggcttgaggaagcggttgatgttatcgctgttgatccgtcaagccagcccgcatttactccagaaaatcgaatgccaattcctgaggaaatcatccaatactgctccagtttagtggttctcacacataaaagtgtgagggtttttcgtagtacggcggaacaagtaacggaaatacaacttgctcacttttcagtgaaggaatatctcttatcagaccgactggagccagatttggccgaaggactcggtgaaatttctgcaaaggctaacattgttgacgtttgtctctcctacctacttaccatacatcagttatgctcgccaaaggaagcaggaaatcaatactatctggcagagttctctgtgcaatattggatgaatcacgcaaaagacgtcgagttatattataaagcaattataccgttggttaaggagtatttccaatgccgaaatgccttccaatttggatgccagcttaataatcagcaagggcataaagcggatgggattcaagctctttattatgcatctctttggggtttactatattcttctgttttcctccttcagaatggcgctgatgtcaatgcccaaggtggatattatggcaatgctctttatgctgcttcagaaggagggcatctagagatcgctgagatgcttattcagaaggacgctgatgtcaatgcccaaggtggacagtatggcaatgctcttcaggctgcttcagcacaagggcatctagagatcgctcaggtgcttgttgagaacagcgctgatatcaatgcccaaggtggacagtatcgcaatgctcttcatgctgcttcagcacaagggcatctggagatcgctcagatgcttattcagaagggcgctgatgtcaatgcccaaggtggattttatggcaatgctcttcatgctgcttcagtaagagggcatctagagatcgctaaattgcttattcagaaggacgctgatgtcaatgcccaaggtggaaagtatggcactgctcttcaggctgcttcagctaaagggtatccctagacagtctttcgcaatcggggaatatccactgcattcagcctcctctcaaaccgacccatttcacaggcctttgatattgatctgtcattaacgagttacagcgacgttgctcaaaatctagatgctcgaacatcagccaggatctgcttctacttcgaccccaaggacaatagcaccagtctagtgaacatcagccaggtcgaacgacaccttactacaatactggccatcagcaccagccccagagacgctctggaggccggttgctggggacatataaaataagctctcatgaactgttacgtccttttgactaaactcaattatgatagtgtgataaaataaatcttaaattaagatctgtctaatcagggtgctttggatttaggtttcgtgtgtaatatgattcttgttcgcttcctacgatagtggctctccccgtcagtctctccaccgacgcttcttcttttcaagacaatacgcgttgtctgtgtgaccccgtctgctactggtttagtcctgtctctgtgcaccagagtgatccgcttcttttggccacttccagtagtgttgcgaggggtcccgcattcctcaggttgcttgggttcgtgttctaatgacgccgacatactatcagcagcgaggagcaacttgttccgtcgtaagctagctatagtttcagtactctcctggcagggtggaggtgcgacatcttctccctgtttcttggttgtaacagtcggtgacaagcctgcgtcttgggcacaatcaaccaaatgttcattcggaactacttctgccttttcgttatgagttggctggaatgctcgaaaaacatcatcgcaagtcaagttatcagccacgtcaagaaattcatccatagacgctggcatagaactccaagagaaagaatcttccgtcgcaggctcagaaccgggggttgacgggaagggggaagaatcatccacggattcataatcacacaagaagggatcatcttccatggatttgctggcaatgtcacacaggaaagggtcaccttctaccacggactcgggcttagtggtcattagcgaaggcgttcggtcgccaatagcttctcggtcgtccatgggatctcataagaaaggatcattttccatcttagacccatgtgaccgtctcaatgtcgggagacaagcgtcaacaccttccaactttggggatagagccttaaactcatccatccccattctcgggcttacagggccagtgttgtcgggctcacccataaaatcgacaatatcgaaatatgttgcacatactcggtcttgtggagattctttgagccccgtgacatcacttggggagtcaggcgtggttcctgcagggtcatcacccatcgacgtctgaacaatgcccttacaaggtgaaacaggcagcctcttatctgtatacgagggctccctaccatttggcaatggtacccgtccatttggcaatggtacccgtccgtttggcaatggcttccttgttgtcccgagttgtgccgtcggagttgacctaactcttatagtataacttagaaggctaaggcaaggtagtacggtagactaatcgatacttagtgtgacggttgggtggctcacactggacggggggtctagggtaagtctgggtgttgctcgtcagagttgatctgaggaggacgatcaagttgtcttggttctgtgcgagtcacggccggtgtgcgagcactgaggagctagtttcaatgaagcgatggcaactgctattgataactgtctaaaggagtgcttctatctaatgaaatgagcgcgtatatatatccgggagatcattgtagcttgacaatgatctggttcctggatcattgggatcatctcgagatcccgacgatccggtggttttccttgaacagcttctcgttggttgaggcggaaaaaagaataggtccccacgtgacgttgattctatcagtgtaggttcgtaacactcaggattaatgaatgtggcaatccggctccctgggggcggtcaacgtaaacccaacaactagccatcttgcttttccacttcccccctcccccttcaattttatggtagaggagtcatagtgttgaatagtctctcaatctgatccctcttgacttctctaaaccgtggtggcgccttcactatcttggagagatgaccttcataactaattaggtgagggcctaagcgaccagatggttttgattatatcagctatcggtaccatgttgtcgtagataggttatgcatccaatagaagatgtcatccttcttgagcgagagagtgcgtgtgactccttcaactgactttgacttgctctcgaatttgagaaacaaccgggaatccgcctcttgaagtgcgttctgggtattaatcgcgttcgagtggcatccgggccctaataaactttgccttggaagtgaagctcagcctcaccgggatttacagcccctggacgcatgttcccagcattcttgtctgtgactgatctttgaactaactatagcttttctggtaatacttcctgcatggattctaaaagcttagagtaggggtattcagcgtcgtatacaaaattctatgtagttgggatgttgatgcggaagctgctagtctgatatatctacgctttgactagcgttaactagcactcctctagcttgggatgtgcttgcggttctttagtaagacatgggatgctcggtctagattcctcagagttatttttaggcctcaaccccccccccagagctaggagttctacttgcagtagagctaaaagctaaacacctggtggcctcatactccaagtggccagaagggctgggtcatgggctgaacaaattgtaacggttctagactgtgagctgagacataccagactgttttaatactagctcaataagtcacggtatgtgcgatattgttcgtataataatactcttcagcttcgcgtcttttcggtgctcctgagtgtagaaaaataagggctgtcccagctaaaaatttaacctgacttgatcctatattaaccttaacactggaatgctatggcgagggagttattgtggagggccttgagaatctgtcgtatagtcttgtgtgcaccttgattactccgtacagttaaaaatattagcctttttaaacgaaaacctaatattcaggccacaagagtgttacgacccatccattgtctcaaatgcacctccaaaatctattgcctcgccagaaccttagcgacctcgtgctgaagcctacttccaccaacgtcatacttaaatagtctgttctacgcagacaaatatataagtaataccaatctcgtctgccgggaaagtgaaatgtccatcatcaatattcgccaacatggaaagacaggaaaactcaaagagtcgcatcattgtccttagcgatgggacttggtgcggccgggaaactggcacgcagacaaacatttatcatcttgctagactcatgggacttccagcagataggcaaaatgctgaagacgaatacacgtggacgacccctactgctcatgccagataccgccatggagttggtctcaatagcacatttcttgattatctcttcaacggggttactgctcaagacctcgcaaaggaatgcatctcggcctacaaatttatcgtgaacacttacactggaggaaacgatatatggctatttgggctcagtaggggagcttatacggttcgctgtgtcgctgggatgatcaataactgtggaatcatccataaatgtcgaactaaggaggagacggaactgctctgccgagaggtgtatcgcatctaccgctccagctatccgatcaaccacccgggctctccacagtcaaaaaaatttcgcaggataaattcctggccattggtgggcgacgaagagaacgacgagtccagccgccgatcacccgtccgatttatgggcttgtttgacacagttggctcacttggtatcccgacctttaccggaggggtgggactagattggcctaagtttcacgaccaggatgtgtcatccgtcgtggaccaggtataccatttggtgtctctccatgaccggttctacatccttcagccttgcctcgctagtcgcaagggcggttcaatgtcagggattgaggaggagtggattccgggagttcattacgacctgggcggacaacgatttcgcttctttcgctcaggagctggcaggctcgaggggttactggcaaagtgcgggttggtgtccaagaccatcgaaccgaatgaagtcctcgccgatttcgcgttgatgaagatgctaaagcgcattcaaaactccgatcagaacaacatcattccagaagccacaatgaatcctgaactcgagagaatgcaagcgagaatcaatacgggtcaaaatacgggtaacggagacgtatatgcgaaaatcgtgaaatacaccccatttggacaatatctctgggtgctcttcactgctgcgttcagaatggctccttcattttgggagttattgttcgcacttagggaccggctgatccctgatagtcaggcaaacgtctttgattttcaagcagaaccactgagagagcttgctggaataacaccggagaggtacccatccaacacacttcagtcctggcttcagtcttggcattagacaagatgaggctgccaactcctaccctcgggctaggccggtctggtttcagttttttgccagttttctaaatctttactttttgttgtagcacatgttgaacacttagtacattccatctggttcattttggacaggtcaagtttgcatttcgagtatttcattccagtttcacagagctggcagaagcgaaaaataagcctagggcatggacctcccaaacagcttgaaaaaaagggcattaatttcactgttatttaatgtttatttaatgtagcaatgacacgatgacaaaaccatactatgtgcttggaacaagcaataaatagttactttggaagcatatgtataaccccgaaggattttttggcgtgtttaagaacccttgaggcgtattttcagaattttgttctcgaggcactcataagactcggtccggccaaatctaaaccaatgaaagcaaggcaaaaattcagcccacgtgatgccatacaacgagtacttgatggcagacaaggcccgagtctcaaggagcaggagagcatcccaccatacgttacaccgccgtggtggcaaggtccaaaaatttacatcgaggaaaccgcagacagggcaatcgctagacaccatgaagagcagaacgccttaaccctgtacacggacggaagcggaataaatggtcatctcggggctgccgctgtgtgtgtcactaacggcgatgtgaggatgtcgtatatgggggatgagagtgtgtccacagtatacgctgcagagctgcaaggggtcgcccgggccccgactcatagctccccggatgtgatgcatgcgtcctcgcatctccatcacatccaaatttcggggccgctccaagcttccagataacttccaagttccattttcgcgtagagatctatttgatcaaatggttgcatatgattttgaactgaatactcgacgaatccttgcggtgttggcgctcaagggggtaacccgctctctgctcaaggacatcgcatcgacattcattcaaaatcacgtgtcaccaattccatcccctttgcgaattcaatttcaattatctgcgccctgccttgtattacctctcgcacgaacaaaggaaataattagaagcttgcaagctcaattagttatgccaactgcacctttctcgtcgtcttcccgccaaaaccattcgttcttgtctccttacttcgacatctgtgtgactgtgccaccctgcgtagataattccctgatggaattcaaaccccaatattctcatatcgcgtgcagaaccgttcgatcaaatggttcctgctcttctcatcttcttgaaaaatctcgtggaatttccaagggctaatcttccttctctgctcccatcttcaaggtcgcgcgtcgcgtcgggcgtatcgctcagctcgtgataacttcgacgagctcttctctggggctgcactttcaaagagggctgcacagatattatcccaggctgtagggcttacaaggcctgcaggagccacagttacatacgtatatgaagtctggtggttgtttgtacgaggggcaacaagtacaggttccaagaggggaattcgtgtggatacgaacagggttgcaatgtggggccctttttcagcgaattttgcgaaattatacggcagtagtttactgccggcgttaagcttgaaagcgggtagacacggcaagtactagctcggctgcttcattacgctcaattgttctaatttctaaatatcgagttttttatgctgggggtcggatgttagatccccccttcatcgtgattcattacctacgtgtccatacgggctctgcaatgcaaattcgctccaaaactaagcaataggcgtacgccttcttcaaatcccaattcaacagctgtgtgtaatggggtcctgaatgagtcatcgtaagagtcaatctgctccaccatatccttctcttgtacgcaatgttctagtaaaattttgagaatggccccatttcgctgaacgacagcccagtagagagcagactggcgcctgttgtccaagtcacctggccgtgccccccgctctagaagcagcatgatgatacctgcgtgtccgtggatcacggcatgcatcagagctgttctcccgtcgctgtccctttcgttgatattagttgagtgttctaggagaacgcacatgatcccctcgtggcctttctgtgcagccatatgtagcgtgctcatccatccgctggactccccggatgtcgccacatcactgagtgatgggtctattggtggtgtgttattggtctcgataggcatggaatggcctacgctgctcagcgaatcggggtacattaatgacaggtccttgctggtgaggtttcccatgagaggtagatcggcggataaatttgagagaacggcctccaaactaactggaagcgcatctggaggagatggtgcatgcagatttgagattggcgtgcacaagcctaaactccccatggcgcttgtagtgtcagcggtgacagtcgatgttgtctgttccgaggttgacgacgtcggtaagtgggtgtgaagttggttgtcgaccccggttcggccgttttcctcgtcgcgggcgatctgatcggacgctacagagtcggttttcttcttgctgtgtttttctggggccgctgattagcttcatctgcctgcaaggggcttctcctcaggccaactaacgacgaaacctgcgttgggcgatgcgattctgcagcctgcggcgctccactccttcgtcgatagtcatggatggctcgtaagagtaacgttgtgcgaaaggctgggccgtaatggtaatggtaatcgtaagaataagcaaggcagccgggttctaaaatatttctatcaaccatgagaaccttataatattagcatcaccgtaagcgattagttattttacggtgaatacatgtgccgaccgggcccctgagctcatatctgtgccgtaatccgtccagtgcatgcggcgtatacgttcacctgtactggaagcgtgcatgggtgaagcctggggggcgtctaagaaaaagttccataagcctgtattaccgatgtcatcaagttaccggctctcttcaaggcattgcccatatccattgacgatggttcatttcagtctctacaactcaatttcctaattttcttcaacaactgtgcggttcgcgactccagagtgtctgaatctggcgcggagacacccggaagcgagcactaacaggccgcacacaactgcataccgttatggaacccgccacgatgcctatcgctattgttggcatgagctgccgcttctctggcggagctgacagcccagagaaactttggaaactgcttgcagagggacgcaatacctggaccaaggttcccggatcccgctataatcagaccgcattttaccaccctgagggcacgagagcaggcgtcgtaggttccatgaatttccttgctagttctacgcagttctactgcttctcactgaattctctttttctttgtttgtacatgctgacggctgatgacactcttagtccaacgctcagggcgctcacttcctcgagcgggatgtctcccactttgacgcaccctttttcaacttccctaccgaggtagcagatgtaagttgtctcatttcctggctagtggtaaatgccaaagggacatgtgagagctaaaatatcacagtctatggacccacagctgcggatgcagctcgaaggcgtttatgaggctttggaaagcggtaagcctagtttcaattcccgaaactgacaaggtttcaaggcatgctaattagcccagccggaattcctatggaacaatttgcggggagtaaggcgtctgtctttgcaggggcgtccttccgggactaccacgacacgctgatgcgtgaccctgacttcctcccacggtacttcctcaccggcaacggcgctgccatgggtgccaaccggatatcccacttctacaatttgcgtggtcccagcatgacggtggatacgggctgctcgacaaccctgacggcgctgcatctggcgtgtcagagtcttcgggcaggggattccacaatctcagtcgtcacaggctccaacatcatgctcaacccagacatgtttgagacattggcgagcgtcgggtacgaggcgaagcactccgaaaagcgggactttgctgactgacactgattgataggtttctgggctccacgggcaaatccttcgcctttgacgaccgcgcacaggggtacggccgcggagacggtgttgccaccataatcatcaaacccctgtcggacgccgtgagagacggcgatcctattcgggcggtcatcaggcagacggcgctgaaccaggacgggcacacgcctactctgacgtcgcctagcaaggaggcccaagaggagctcgtccgctcgtgctaccggtctgccggcctcgaccccgtcgacacaacctacgtggaggctcacggcactggtacccgggttggcgatcctatcgaggcggaggcgctcagtcgcgcgctgaacagggacaggccggtcgatgagcccttgctgatcggctcgatcaaatctaatatcggccacgcagaaactgcgagtgggttggcaagcatcatcaaggtgagcctggcgctcgagaaggggttcataccgcctaatgcggacttccgcacatcgaatcccgcgatcccagtcagggactggaaaatcaaggtgagggagccacaaaaaaccagaggatcattggcctgttcactaacttgctcactcgaacagatcccaaccttcttgacgccttggcccggcactagccagtaccgaagagcctcaataaacaatttcggctatggaggatctaatgctcacgtaatcttggaggcacactcgtcgaccagcctttccgtcaaagcttattccaacggttgcaaggggagtgatgccaacggccgcgccaatggccacaccaacggctccaccaacggccaccatgccgaagtgccgctgccaagagtctttgttctcagtgccaaagatgagaggggcactcgtagaatgatggaggatcttgcggggtacctggagaagaagcaggtgaaagatgacgaggagcttctcagagatgtggcgttcaccttgggtcaacggcgttcccggtttccgtggacagccgtggttgcagccataagcaagtcgcaactcatacagtcacttcaagatggcatggccactgtttccagatcacccaagcaacctaggttggggtttgtcttcacgggacagggggcacaatggcacgccatgggcagggagctgatcgaggcgtatcctgtgttcaaagatgccttgcttgaagcagaaaggcacatccgcagttttggtgcgagctggaatcttctcggtatgtggcatggactagccccgactcatgtacttacttcacggcacatactaacatgggcatatcagaggagcttatgcgggatgaaaagacaactatggtcaatgtagtgacgcacagcttgaccatctgcacagcacttcagcttgcgctggttcgcctactgcgttcatggaatatcaagccagcagcagtcaccagccattcgagcggagaagttgcttcggcgtacgctgctggtgccctggacttcagatctgctctcgcaatctgctacctacgaggcaccatggcgactgatttcaagtcccgtgccggtggcatgctcgcagctggtcttgggcatgccgaggcagaggagtacattgccaaggtcacatcgggcacgatcgttgttgcatgtgttaatagtccaagtagcgtgacaatttctggagatgtagaggcccttgaggagattgaagccctcctcgtagctgacaaggtgttcgcacgtcgtctgactgtccaagcggcctaccactcaccccagatgcagccatttgccaaagattatcgtgcggccctggctgaggtcctgcaccaggcaggcgagttcgacgacgttctttactcttctccagtcacgggaggcgtggtgcaagatgcctccgagattgcccgccctgagcattgggtcaagaatatggtgcagccggttctgttcactgattccctgaccaacatgtgccaggtcaacggaagccaaaacgttgacactatcattgaaattggacctcatagtgccctgcgaggtcccatgcgccagacttggtcagagccggtattcaagggcatgcagttttcatacacgtcgtgtctggcccgcaagcaggacgctgttcagacaatccaagctttggtctctacgctgatcaaccaaggctacccagttgacttgggttctgtcaatttctccacatctcgacatgggttgcgagttctcaccgaccttccatcatacccttggaaccacggccagcgctactgggtcgaacctcgagtcaacaaagagcggaggcttcgtgtcgagggtccgcgaggtgtccttggtgttcctgccgtcagttacgatccatccacctcgacgtggagaagtgtgatccgctcgtcggaattctcttggatccaagatcacaaaatccagtcagatatggtattcccgggagctgggtacattacaatggctattgaagccattatgcagaccagacgctcgactgagacatctgtcaacggttacaagctgaaaaatgtcgagattttgaaggctctcgtgattcctgacacactggatggagtagagatatccttatctcttagagccttgggcgaccgagcactatctgcgaaagaatggcgtgaatttaccgtatcctctacctctgacgaaggtgttgtcacgattcactgcacaggcctggtagcaatcgtagaagggccatccaacggtagctccatttcgaatggatctggtaactacgagacagattcaggttcatatccttgcgacctgaagccgacagagttatacaagtccctccaaagtggtggaataaaccacggcccttccttccagaaattagtttccgtttcctcaggggagggctgttcccgaagcacgtttgaaacacctagcagctctccacacgaacacagctacttgatacatcccattactctggatgtagttattcaatctgtgtatggttgtcttataggatctgatagacggatagcaagtgggatggttcctcggtccattgaatcaatgttcatttcttccgagatcagtagcatgcctgggcatatgttcaagaccacttcaaagttgacttggctgaatgcccagggttttgagtcatccatcgcagtggtcgataaggatcaaccctcttcgaatcgacttgaaatcagcggccttttctgccagaaccttggaggcgcccttcaaacaggtgattctgagactgcagagccatattttcgtgtcgaatgggcaccagacctagacttggcgcgccctgaagttttgagagcccccaaacaggtctcgaagaagccaactgacaacgcaattttcgaagatatcagaaatgcctgctatcattttgcgcacaacactctgtcatcctctgaagaggcacaatacgaccaagactctgaacagggacgtttctattcgcgtctggagacgctggctcagtcggccaaagcaaatggctggaccccaagcacgccagaagagcaagaggctctcatcaaacgggttagcgaattgagcgtcgctgggaaaatcatctgtcgcattggctcagcgcttgtcccgatcttgcataatgaagtgaacccacttgacttggtcgagaacgatgggttgctatccaagtacgatgaggaatgcctcagacttccagattcctatgagcaagtcaaacacattttacgcctcttttctcacaaaattcctcgagcgagtgtcctacagatcggcgctaggacaaataaatacaccgaagtagtgctggaggcgctgggggctggttcggatgatggagacgcggctcgtttcgcgcagtacacatatacagcctcttcacctgagttattgcaatcggttaaggagagattcgaggcccgtgaaggtgtaatgcgtttgaaagagcttgatattgacgaagatcccacaactcaatcctttgagcagggctcattggatcttatcattgcatgcgaagcactcttcaaggcaaagtcagtatcagaaacactcaagaatctgaagaagctgctcaaacctggaggaaggatcttgctagtcgagcctacgcaggatgagctggccttcacgttcgccttcggtctccttccaggatggtctgggcaatcttaccgtcgtgacgaatggagatctttgcttcgcgacagtggatttcaccttgagttcgatgcatgtgacgaggacagcagagatgtctatgctcttagcacgattttagccatcgcaaaggagagtgatgaaggcctgatgggaaaatatcctccgatcacaattctctatgatagtcctcctcccgaaagttggactaaggcgatgaaccaaacactcttcaaccttacaggagaggtgccgcagttctctcactacagagacgcgctgatcgtcgataggctttgcatcttcgttgccgagatgatacggccattcttgttgaatcccacaaatgaggaattcaaccttgtgaagtcgctcttcaaccaatcacaaggaattctttggatctctcgtggaggtgctatggactgcgtggatcccaacttcagtctgagcgccggcctattccgtacattgagagccgagtcaaccaacaagagattcgtgaccttagatcttgatcataacaacccagagtgggatgtgtgcaccactcagattatatcagcggtgactagaaacacattcaatctcgcacaatcctccgagtcaatcccggacttcgagtatgtagagcgtgacggcatcatttctctaccaagactcttccctgcgccttccatctaccagactgccgccgggctcgctgacaagcagtacgaaatgcagccattcttccaagatgatcgcgagctacggttgtgcgtagggactactggacttttggatacactctccttcgccatccaggataccgagacccctctgccggacacctgtgtggaaattcgaccacaggcatttggactcaactttcgagatattatggtagccttaggtcaacttcaaacagataccatgggctacgaatgcagcggtatagtaacacgggtcggcgctgccgtcccatcatccgaactcaaggttggtgataggatctgcgcattcacgcaggggtactattcaaacgtggtgcgcgtggactggacaagagtccacagaattcccgataacatgtcatttgaagtcgcggcttcggtacccatggcgttcgccacaggatactacgctctctacaccctcgcaaatttgcagaagggcgaacgggtcctgattcactctgcagctggaggtgtcggccaagctgccgtgatgatggctcagcacattggtgctgaggtctttgtctcggtaggctcaaaggagaagagggaattcgtgcaagaaacctacggcgtccctgctgatcatatcatgtctagcagggatccctcctttgctcaagatatcctcgccaagacaggaggtcaaggcgttgatgttgttctgaactcattggggggtgagctccttcagtctagtttcaactgtctggctatgttcggccgctttgttgagattggtaaaaaggatttcgagcagaaccgactcctcgagatggagacattcaagaagaacgtctccttctcaagtattgatttggtcctacttggaaagtacaggggactggtctatcgtcaaattctggccaatgccatgaagatgcttgaagcagaaattttgcggcctgtatctcccattcagacatatccaatctcggatttagaaaaagccttccgcttgatgcaggcaggcaaacatatgggcaaaattgtcatagtgccgggtcaagatgatctagtcaaggcaagccatactctagctttaccagagttattaaactaactatttcgcaggtcatacctcaggaatggtctcttcgtctagattctaacaagacatacctcctcgcgggtggcttgggaggtattggaaagtcaatctgcaaatggatggtaggccgtggtgcgagaaatttcatcttgcttacacgtagtcagagtacatgtgaaaaggctgcaccattccttgatgagcttcgagcatctggctgccttgctattgcaaaaagctgtgattttggtagcaaacatgatctcgaggcggcggtgcatgcttctcaggattttatgccccctatacaaggagtcataaactgtgcaatggcccttcgcgtaggttttcctctatctcctcttctgaaacataattaacaccagctaggattcaatctttgacttgatgactcccgagggctacgtcactgcaatcaatccaaaggtgcagggatcctggaacttacacgagatcttttcgtccactcagcttgatttcttcatcatgctatcttcgcttgtcggtgtggcaggcaacgtgagtcaggcgaattattctgcgggcggaagcttccaggatgccctcgcccggtataggaatgctcgaagactgcctggcgtgaccctagatctgggtatggttagttctgtaggatacgtgtcagaaaacgaggctataggcacacgtttggcccggttcggcttcaagcctttagacgagggcgaagtgctgcgccttgttgaatctgctatgattcaccctcatcgccaggtcgatgactctcacatcgttacaggtctgattactgatctgagcacggtagacccatccgatgcctactggaccaaagaccgtcgttttgctgctgttacccgtgcctatgggttgcaaggcaatggaaataccagctcggcagacttgaagagccagctagcaactgcaccttcaattgatgaagctgttgttctcttaagcacttcgattgcggagaaaatgtccaaaatgttcttgattccagccgaggacatcagtttggatcagtcgctgacgcactacggagtcgattccttggtggctgttgagttgcgaaactggcttgcgtcaaacactgggacggatccatccatttttgacattatgcagagcacgtctattaaaggactagccgttcgcattatagaaaagtttagtagagattgaagtaaagagtccatattatagaatcctaaacacctcacggtgatcagatagacctagacttcaaaatcgacttttttctaagaaaggctcatctttgaaaccctgtcgtatatagaacagcaaatttatctttcacggacatctttatattatataatataatctcatcccagattcctttctcttcattttttataaaaaggttcagagcccaagaactagtctgggagattgaagaactcgcatcgtagccctatagccaaatgctgtgtgggagaagagaaatatatccgatatcgacttattacctagattctgaagagcggcttttcgtccattattatggttgtgggtaatgaaaaattccgatgctccagtcgttttcaattctcgttagggtccgctcatggctgtgattggcatcaaaaagcccggatcatcccactgtttctttacagagtttgattctctaccaaaatatacatgcctgggtatgctgcagatagcgtaaaaccaaccctcgagcactcaactttttattttgctaattctgccgaagaccatatactatgccgtatgaatagggcaaatggttcaggttcaacatagtgttacagagagtcgtacttctttcatatagaaaccaccggaggatataatactcttagtagcctcgaaatcgaggctgagttggtccctataacccataggttagagaaacggaaaatagacaaattgaggtagagtagccttgcaatgacttttcgagacctgcgaatacgagaaaagccgaagtcatacgatgatgagctacgtagatatctatgaaatcgctgggtaaatctacaagatttccaaaattcctgtgctggatcacgtttctaatctttgatatttcctagagacattatggaggctggcgaagatctggctccacaaggatttggttctactatactgatcgaggagtttttaaaaagcttgtgcatttattggctgcatgattgggaggggggtgataacgaagggtatgggaactgactagaaattaaatcgagagagccaaagtagacaagaagagtgaaactatgaagctgaggctcgtaggaggtttccattgactttctatacggctaccgctagatattcttggtgagggcccgggtataatgcaaaaagcagtaatagaagatgctagacccgatatcttaacacaatgagaccaccgctagatattttccagcatataatggggtttcaggctgagttgtatacacttaagtcgcccaaaggcataggaagtttcttggattcgtatagcaacaatgataacagacaaacagacaacttttatttatcatcaacagctaagtaaagcaaccggaaattacatgtcgacggtttcttcatcttcaactccaaatagggccctcatgggatcctggtagtgcataaacccaataccaggctcacaaacgccgtaacccaaaaggcgttgagcttgaggtttcatctgcctcactctctcgactgggatctcgaggaagaagttctcggttggtcggagggtaggtttacataaaaaggttccgagggtctctcgataatcatctctggggaagaaacaacagtcagcgttaaaagcaaatcgtaccaaccaatgaacaaacgtagacctacttagtaatattggagccacctgcatggtatagggttcctaggaagataagtgcgcccccaacttcgagctcgactgggacagcttcttcgtctagtgggcgacgttctggcccccaaaggtgtgagcctggaattgcaacagtggcaccattctctttcgttgtcttggtcaaggctgtaacacatgagatcattgtaagagcctcgcctggtttaggatggtgatcgctgttcactataagttagcttcaaatgaaagggcgggcatggataatcatacttgtcatctcggtgaagaacctgttgtttgcctccagggtttactcgaaacccgagagcagctgacaggatgggcttgccgccgatcgttacctggtggtcacctctccacatagtgtggtaggaggataccataatgttggcaacatccgtgaaaagtttgttgcatacaagctcaacgcatgcatcagattcagctagtaatcctgtcgcacgctgggtggtgggtgggaaaagcccatacttgtccggtatatctctttcaaagagcggttttagatcttttctgatctcaccagcaagctcttgggaaatcaagttctccacaataacacccccatcacgctcaagaatctcgacgagcttctctggggtgatttctggatttgtagcatcaactctgacaatcgtaggctcttctgcggctacagtcattgtggaataatgggtgttgagctttagtttagattcacaagatgggaggaaatactgggatcaatatcgatttagaactttataattaaaccaaaaatgccacagtcatatgaagaatatacgagatgatatttatgagaatcctagaaagtagttgatgtagattgtggcgtgatagactgtggcggctttgctcaattacttgtgcccttttccaagctgcttatgcttatacgggctccattctgcttatcctcctaaacatgcttatgtgtttccagatgcttatgccccgcataagcaatatcatgctcaattcccttgctaatggtcaatttctcttcaaacaatgtggctaaaaaaaagcaccgggattcttgtcaacgtgactagtggttggtgctggctacaacatattcctttaaagcgctcattagattcaatcttgataggcatattttaaagacaactgtaactcatatggaactgtttttttctttacgttagatagccgttactgtaaatagtaatgaatgtatttcgacaacattgagagaatttcctcacagaatagagaaggttatgcttagaaggatggaacctaactgttttagacacttcagttcatacctaatttaggattgacttgtaaatttagtataaatgtggcagttcatcacagaactctgagtagtaccctaactgggccgacataagcaattcaactcttcattgactaaatcaatatcgtatgttgtggtcctctcaagctgggcattgttccgtcatagcttcgccaatatccacaagctcgctgtgactaccataacttggggattctgccttgtagtcagtatcgactggcgcatacatgaaccatgcgctcaacggctgcgctctaataaactcctcatccgacgtcttggttctgttcacagcgacatttcctgctaagagatatgccattgtattagtccccctttcaggatagtccatcatcttcatcggcaccttggcatatccaattgggatagtgaatagttcctcttggacgtaagttactccatcaagaacgacctccccattcttattaccaccccaattcgcgtctgaattcggcttatcctcacccaatgcccgctctggcagcgggtaaactcgcagatcaccacttggtcgccatttcagaaatccggtaatccatccagacacatcatactctgcaccactgccgccacatgagaagtgcttcttcgcgcggacgatctggccccagaactgcttcgtttcgtcactttctggctcatcccaagttcttacaaagcgactaaggataggtcgtagttcttgagcgtattcctcaggctccttgccgaattctttgagatagtcaagtttgtccaacagttgcacccagtcttcacgctctcccagcagtgtgactttcggtaagccacagatgacgccgcccgagaattcaaaatagtgctgcatcaggcccatcataagcacggtcgcagtcaactcatcattttcgtcactggttgtaaagcccggcataatccagccatagagccacggcgttttgatcctcttctggatcgcctgagaaaatgcaccgacgacgcgacgccaggagaattccttaaccgtgatctcttctttgcctttgtggtcaacaaataggtggcggatatcttcagcatgctttgtcatgtagaaattcagctgcgtcaaaacctcaaaccagacttcgtcggggcgtaggacgagatgctggtgtttggcccacgcctcaatggcgcctcgcacaagaccgtccgacgaagggaagatttggcccgtaggctcgaacgcctcgtccgatgcctcgaattcagtaaaggttgacattaacactttaggtcggtacgggagctggtcggacagctcctccgggcagctccggttgagcagttcggtactcgaggtaacggccgtggagatatcgagaggtaaaggcttcacattttcatcgactgccacagtgatatcggcggcagtcaaggtaaacagcccaaagattgcaatcagtgaagtagataccattttcacggggcatcaaggtcgcctggttttgaagctctgtccacgaagccaataggctattgcgatctgggaagagggtctagaatacgaaaggcgggatggctgtcgccttttggtggtggtaagattgggaaatggacgagttttgatgttgccaagagcgtctcagacatcagacattccgaacacctcagcaagtaatgcggcaacaggccatttaaattccaaagctaatgacccaagtagtaactttagtcatagaatcccctttgcttcgtccaagtcccgcaactttcacagataggattcaaaatggccaatttgctttgggctgtgtcgaccatccagcttcgtattgcaacgccatggagaattagcttcctatgtccacctattggaatcaagctcacggttgtggctgagaccaagactaattgtttctcaaaactatcggcactctattataccgaaaacgtgccacgtgagaggtaatttagagagggggaaaatgatgacccaacacaaccatttatcgccacccgtaaagccacaaactggagctggcagtattcaaagtgaactaaagttaaataggcatcgtgcccttttactggtgtgcctggtctagccaatccacgtaatccgcgccaaagtcaagtgacaacacaacatagttttccggaacatgttgagatatctatcacatgctaatttcctttgaagacaacttttacccctttcgagttagacaagaacctttcaagcacagacaaggctaaaaagttagatcgggtgtattgtttacaaagaggtacgatcattaaaccaagccccattacccgcttgtatatcatgtaactttaacgcgccggcactttttacatattgcaccaagggtaatcttatcggatgggttcgcaagactggcctactacttgcaccatattcaaaatctgattaaaaatggcaaattgcgatgtggcactcaggaacagggttttgcctggctaccctttagcaggatcttgggtccatgtaaacgagtggcgattttagacctcttcagctaaagtaacttacaacttgcatgctgggtatcccgacacacaactgatgggctgaaaaaagtggttaatgcaagctgagacaaggtactgtgaatcacatcaccttattacccacttcaccgccattcaaattacacagaaagaggacagcaacgatttcttaatgtattttaataactatctctttgattgagaacagagttgttgctctctccgccttcttccaggctgatgccagcatctgcaactggcaggaggtttatgcagcctacccataataatcgttatatcatagtactcatcttggttgttaagcatctccccttctaaggaactggaaccaaatttctaatccgaaaataacgccacagtgatatacagaggtcgggtcgttccagaccgactttttgttgagaacaatgagagatctctatctctctctttttcatttctttttttgcaagaaatttgcgagcgtgtcccaacaatcatgtagattacttgaacccgttcatttgggtacgaagcatagatgtgtccatgattagtggacgacacccaagaatcgcattatcgaaagacaagtgcggaaattcttggatttcttcttggaagccagaatctgagttggctaaagggtcgaggaagggatcgctgttattgtgatgatctggagcgtggtcggaactggggtagggctcggagtcggtgttggtgtgccagtgctcgcagggggtttcaagtcggggcattcacacccatttttctcagctaggaaacattagcaggccaaattgttggaatgcgtattcatttgctcttaccgcatgatatagtttgctcatacacacaagcctcatcggcctggcacgatggagagctctccacgttgtagtagacgcacttctcgaagcccctctgtagcatatcgctgccacaggtacagcttgcttcatcgtcacggatgttgttttccgacaagggggtcgccgaagccagggctgccagagccgcaatgaaaactaaactgttgaaacgcattttgatgttggaatcggcaaggaatacaacgttacgaaatcagaaaatttggtcgtcaagtggtgaagaaggtgatcttgcggtgggcttttatgttggcttgggtaaacgctttgccacaggagaagctcatgaaactgagttggtgtcaatgtccccggcctgtttcatttgtctgattgccacggactgttcgtgtggagaccaacatgctgatcccgtctgcaaggggtctgtcaatgccaatctgcacatcgcacgctgctcggatgtttcgggtctgatttctcttgctatttaaggtttagggaccttttgcatttggaagcttgacgcgttgctggccgaggtggcactgcgatcaatcctgtgaaggattggtttgcaggatcagatacaggtattcacgacccacaatgagatgatcccatccaaactcgaactgtcgcttgtgcatgagagagggctggctgataaatgggatgaagctgttggtcggctggctttggcatggaaaacagttcgagttgcatcaacactgtgttgtatgcatatcatttaatcttggttttccctgcacaaacattctccttcttacttcaggcaagatgtatctcccgcatgagcgttataattcagcggttccttggtgcagtagaggcaaaaatccagtgtcgtcgtttaccctcattgttctaaagtgatgttttggcgaccaaacgcagttttctatactttctccagttgaatttcgattcaatcgtgctcttgctaatggctggaggacgatgccgcctcgtgttcgtatcattaggtgtttttgaatgacaatgagtcagagcccaaggttggttgcgatttatgccatgggcccagatagaacattttgaaggcttgatgcctgttgctatattgttgaattttgaactagctacgtgacagatgacgccataatgtgccctcacggctgtttaggtttgtcagactgctttttttctcgtctctcgcacagaattgctttcagtgtttgcctggtttataagtattattattggtataaatgagaagttagttaaaatactggttcctattgccggatattacgatttgcaacaacatactcaacataaggtagttgatatgcgacttagtttatgaataactacataaatcaacacttctcgtcactttcgcctgccatatactgatactccttcataggacggtgggggttgctgtgtttgaaacaatggtgctatagatagagacgcgcctgaccccccgaaaaaaaaaagacaacgtcccccttatgacatagatctgctacgaaccgtttaattgtgccgtgctacttctgcggcaggttatggaaaatgagtgatagtaaagcttgaagaacaaagatacttcagccgcggattattttcgacgacgggttttagagtagctgggtaactattccaacgacaccagacgtggatgtcaagtattgttcactattgaaatattctggcttacttgcaggatgttgtgatactctaattcgatgggtcctatgcataatgttgtttcctctgaatttcttctatgtcgtatttatcggtgatgcaggaggcaaagtaagcatacttgagttggtgatgggcttttttctccacagcattaatcgcaaacttcaaataagacaaacatcattaaatcgagggcatatgtgaacgaaatttggttgccaagaccgcaatatcacaaacatttgagtaaatcacagtaacgcttatattttccgaagatctttaaaatagaaagtagcataacaacatcagaatatatggatttatccaaagtcaactaaatatgacacaaaaggggaaggcctcccaggctggcaggtttaactgtgtgatatcgctagctatgctaagaaggtccacgaggagattcaccgctccacaagtactgccagaacaatagggagtaaagccctagacagtatggtaggatccaatctatgaatattgaaaagtctctttatcctgaatggcatatatagtgtcgggatgcacggtgtcctaatattttaatgctctataagttatatatagaaacaaccaatccatataaagatagcatgttcaattaaaaattcattagtaattaaaccaacctacttacatgaaaaaccgctcttgctaggtgtgggaatgacagaaaggggagtgagtggctgatatttacgcaagactcgactctgtatgtagaaacgatagaatcagagcctcttgttcggccgggccttctccaaaaccatgtcccaactacccagccaaaattacacacatatacctgacccaaaatccgagattcacacagcataggtaaaggagggtgctgactgcgtacctgatatgtatagccccggcgcgtacgttatgctcaatatcgacagaaatatatagaaagttgagaatatacatgcaatagggaagaaagcgcaggtactccagtcttaatttgtaacgctatatccccgaaacctgtctgctaagaagcgcatgacgattggtcttcctgaattgcagcctatcacaacaccagagtcaagcaaaatcttgagccaggaagaattgggtctgaattctgacggcagccagatcagattccgtccgtcaaaagtgatccagctgcgatctaaactcaggccaaagccggaaaatctattctgaccacaacgcagtataggagtcatacgctgaactggtttcctgttcggcttgtcaacagtgataatgccagcatcagtttgaagtttgttggtagtaggaaatgaaagacaggtgaaacgaaacccgattttaatgacgcgacatagcatacctgtgccaatttcccaaagccggaccgtctcatcatctgatgccgaggctacaaatcttgagtcgggtgagaacgcgacattattaccatttccctatgccccccgagaacctgctgtattatacctgagctagtagcccaaagttgaacagtatatttaatagtattactaattgacggcaatgctagtaacctaccgtcgggcgagaacactgctggtgagatcattttgtcaggaccttcgagggtccggtgaatcaccaaggaacaggattcgacggttttattccatgatgttgagattgggacgacagaatatagctccgtgctactgtctgatactgagacgagaagtttcgagtcaggtgagaacgcgagcgaccccaagtcaaattgatcgagcggatggccccccatttcatatagcaagccacccgtgtcggcggcccggaggataattctgcccattgatgccaacgccacaagcttcgagtcgggtgagaacgtaaatttccaaatagcagagttgaaaccgccacaatttttggatgtgtgtctaagggcgcctgtgtcgacagcccaaagtcggaaagatccatcctctgagcctgaggccacgatcttcccgtcaggtgagaattgaactgccaccacaggcgcgctgtggtcttcaattgtacgctgtagcattcctgagtgggattcccagagccggacagtgcgatcgcctgatgctgaagctactgttctctcatcgggagagagcgcgagcgagtaaatggggcccctacggcgtgtatttaccggcgcgtctatattaacatcccacagccggagagtcatatcatgtgagcccgaggccacaagcctaccatcgggcgagaatgagaccgagagaacgccctgcctgtgaccctcaagaacttgctgcatgacgcctgtgtcggcgtcccagagctggatgatcccgtcatttgacgccgttgctaagagcttcgagtcaggagagaatgcgactgaattgatattacgacccgaaaaaagcgtgtgaagtaggaatccggatttgacatcccataattcgataacggaatctgccggacgatgttcaacagtagacgccaagagcttcgaattgggcgagaacgacactaaatagacacccagagagaactcagaagaatagacatcagtagaagttgttatacttgtagtagcatacccgtgtcggccttccaaacccagactttatggttacgcgagctcgcggccacgagtttcgcatcggatgagaacgtgactgatcgtaccattttaccatcagtctccagagtccgctgcagcgcgcctgtagcggtcacccatattcggactgatttatccctataccctcttaccaataacttcatatcgatggagaaagcagttggaaggttaggggccgcgacatggattctttgtgtttgaaggagcgcgcctatgctggtatcccatagccgaatgatctcatcggatgaaactgaggtcagggtcctcccatcgggagagaatgcaaccaaatctatcccttcactatggccctccagtgtccgcaccagagaacccgagtcagagtcccagagtttgatggtattgtcctccgagcctgaggctacaagcttcgagttgggtgagaagacaacccagtttacagagtctctgtggccttcaagcgtctgcatgtttgagctccagttgggaggaaccttgggctgcagagatatccgccctggtatttgattttcaaaaagacaatcggattatgctattttgaggtgcaaatataagtgccgatgagtaaacttggaggggagcctgatggataactgggccgaaggcaaggataaatcgaatagcgtcgtctaagaaccgcgcaatttgtgaactggcctatgtatacgagaaatcagtacgtatagaaaaggctctcttgtcagaattgcacataccagcaccaaattccgcacaattcttaagtgctcggagaggaacgtatgcacttcgccaccgtccaatatatctacaccagattcacgtagatggtatgcccagtgctcacatgcgtattggacttcatcgggcaaaattgtgctaatcttctctgtgtcaatagatgaatgttccgttccgggatggcggactccgcaaatgtcatttcgaagtgaccctttcaatatacgaaagcaatttgttgctaattgttcatgcgttcttttctggtctatccaaatggattcttttctgattgtttcggatccaggaggaaatcgcgaaatgataggtgcaacagtctaataggttgctttgacgatgacggaacgctgagcaccgaatgtaacaggtccagaaggtctgaaacatcctcaatcggtaggtcaagcaatcgcgccaatgcagatggggatagaagactcgcaagaacgacgatagaaccaacgactttttgaaattgcgctaaaacctcctgcgaatattggccggaaagacctgcaagtagctgctcaaggactactaagtacatagcatcaagcttggatccttgagctcgtgctctgttcatcaaaagcttttcaagctttttccgagggttgccacctactcgatctgcgataaagagacagaccgtcgccgcggaaatgaaaagtggcactgtcattttgatcaaatcctgactatcttgttgtgtaggccaggaggctggcagctgtcgttcctcttcttcgacagattcgttgtagtcgtgccttatctgttctagctcatgcgcaaggaacgcagttatgtcatgtttgatcactgagtcagctatttcatgaaggatcaccttatcataggcgcctttggtagctttaaagccaagtcgaatgggtagctcgggcctgctggtgatgaaaaccttcaatccaggagccttttgcctaatatcagaaaaaagcttgatgagcaacgtcatgtctttctcaacttcacattcgtcaagcgcatccacgatgattaggtatgaaggagctggtagtctcgcagccctactagctattaaaggcttcaaaatgaggttttcaaattgcactggcattgctttttccactatgacaggatctgcactgatggtgctgtggatatgctgcgcagttgctgggatatatcgggccagctgagccgcaatggtggtgaaaaacttcgaaacccctcctcgatcagcttcacctttcttgaagaaaaagctggcagcaagacggccatctgtatgacaagacgatgctagtgtgcgcgaaatagttgatttccctgtgcccgccatgccattaagccaaaacaatgcctcggtttgcggatcatcagcccattcggatatctgagagagtagttcaactcgagtgcctttcaaacatgtaggattgtgttcttcagcgtgggaatcaaaggcagctccataggcaatcggcaatttgctaactgccctcgtttggtaatcatggttgtcaatttcccgtcgaagccgcccaaacgctttttctttcccttcgccgtaaagcaacgggatttgaacgtcaaagatgccgaataaagagtaagccatatcttctgccttcttggtttcacgatgttttatccacaacatccgctcttccacactaaatgtcgatagctgattgtttcgaagggccggggcgggaatctcagtgatttcgcttagtagtgactctagcgatgctttatcacccagcctttccccattagacgagaaaaattccactattgatggagcaagtagctcttgaagtgtccagcctcgaaggaaccatctgcttgctcgcaggcctaactcccggtctgctcggcgtaggtcatcaacctcggccttccttggaacatctgccaagtacacatagcatttcgcggcattttgataccagcgaaacatagagttcagagattcttgaagctcggtgctgcttgacttgtcgatacagcaggtgtctacccagaaatagtgcagaccgtccgaggtagcctgcttgccacaaaactcaatctttcgatatccctctttgcctttgcctttttcctgcatgacatcttgcaacgtaacctcctgctcatcttctccccatgtatgcgagaggattgcgtatgggggaatattgtccacaaaatttctagtcaggctcaaaaccccattttggagcaggagaagccgcatggtcgcaggtacggaactgaacccgcgacaaagtgccggatcaccaaagctgggaccccggaattagacgcttctcgtgacactcgctgtttctttttctactgtgagtgtaggtggttcgggcacggaaggagatgattgaaattgtcaggctggcacagttaagtgcatgctgagctcacgcgatatgcgtgtcaacccaacggcggggttgatctgcctgacctattggatgtgcagttgttgttctctgcctacttccaaaaacgccttgcgtctgccttgagactttcgttgcgaatggagcatagatttgcatgagtcctataggcacccaacacgcacaccaatcaacccttctctcctaattgagattaccttatagaatgcggtggtcagttcacttactctcttttgaacaactttaaagacaaagtaatgagcttttttctttgtgaatcctggcatccctcaagttgttctttgtgcctctaataactttgagtcactacagttacatacagcgatgtctcgtgccatgaacctcgagagtttcacattaataaattattggcaattcatacggactacttggtaagggctgcattagcgacgatgtgcggagctttcttacagggagatttggtgcaatcccgtttaagaagccccaaccaattattaaccacccacgaaggataatgtggtcaaataaatgtcttgtctatttgcaagtaatacatcgcgagcccgaccactttgaggtcattgttggcagaccaagaatttataatgagtacgtaaggggacagatcatcgcaccctgcaaatggctcttttattatctataatctaccaacttagagttgatataagttccatttagcccatcttgttccactgtttcgaataataccatattttaccgtgatccagtagtgttaccttaacattttcctgtaccgatataacccgcccttgggtcgtattgttcagtttgaatcgctcgacgaccaaggttccttggcagaatcagagcaccgcttgcgcacagcaaaaaccgacgtgatatggcccagagcccaccaggcaaacagaaccggcaacgccactcgcagctggctgccacaccccgaccagatgtgaatcatcaacgtgtacgctccgctagaggggagggcatagccaatcttgtaccatgcaggcatgatctcgtatggaaacaccgtgctggcgacgttggtgataatccaggggaagacgaagaagggcgagaactgcatcggtatgtagcaagcgatcagggtctccataacttgccagtggatatccataaggagccagtagagcatccaggatttgcagaagacggcaccgtcaataccccaactctctcggtaagcataaatataggcagacatggatagcccgctgatgagggtgtatattttgccagtacagaatcgaaatacccagacgtcacgtactgatgctgtcgaaaagaagtccatcttcaggctaattccattcagagccaggatgaaaaagaactgggccagtggaggtataaccatgttgacggtattgtagaaggagcggttgggttgaggagtaggctggatcagatccgctgtcgttccgatggggttgaggtaggttttgatcgccgggaggaggacgctggaagtgttgaggttcatgagtgcactcttggcattggaagattcgtaaaatgactcggtagtggccttgacaagtgcgtttatgcccggtagtaggacagagtcggcgatatttggatggcgtgcttggttgtaaaaataagtcgcagcggtggctgggtcgtactcgtccgtgctcatagagccattcattatcccgtagaatctatcagatgaaccgctgtttatgataacagcagcccagtagtcggctttgcagacagagttccgaatcgaatcgaggtcggggtagtcttggctcgaaccaatcttgacagtcgggaggtgataacgtccgtcaaattgagagcacgcgagagttaacgcagctccaatgtcgccatcgtccaggttgattgccaaaatatcaagattgtcgtatcgagatgcttggtggaaggcagtgccgtagagatagcacatacctgcgaggaggagcaactgaatgttcaccgcagtcatgatagatgcgatgaacaatgcaggcgtgaagggcccccgactcttagatggttctgaggtcattgttggatggttcggtaaggcaatcttttctgaatccaaggaaaagcctgtgatatggctgtgaagagaagaatgaaaggagaaccacagccggggagaacaagctgtagcagggcatgtctcaataaatacatattttcgaaggaaaaaatggcaaggctttcttttaaatacatctgtaaatacatgcatttattcatgagttgcccctgtcagtttaggagatttgtgacatgagattgtattcaagattcacgaatcaggaatacttggcggggggggctcctcttctggcagacccacagccgaaatcattagctactagccgtgcccccaacttttttggtccccaagcactccaaattcctttcctgcttgagccaactatctaccagaaagtagtataattatcgaccgtttagtcccttttcctgggcaatgacttaggctgattcggcccctgtaaaatcactcaagtagctaaattgtcaatttacccacaattggtgcataatcctgagacctaggaaatctctattaggtccctcgtcaaaagagtgagctatacatctactgagcaccaaactgcttctttctagattcacatgcacagtttagcttagaatcacatatggcatgttctagaatcacctcaacatacgttgtggtggtggaacgccaagctcatgtgtgaatccatgagttccagaagctcccatgggccataccgaatggcggcatctacccgactggccgtcaccaagcttttatctaagtagctattcttcaatattactatgccaggtttgagtttacaactgcgataccacttctcaggctccttcaggctctgacttgattcgattcatgacttaggtctcttgtttgatgttcattggtcttcatcctcccccttccctataaaagtccctgcgataggtaataactcgctcagctgaccagggaaatgcgaacacgtatgtacaggaggccaaagaacagactgttatacctctttattagaaactcgatgcaactaactaacctaaaagctcctgctacctgggttatgttataaaatgaaacccatacgtgaatatgatttactgctaccttgaatttctttaataaggggctcgaggcaagtgttgtatcttttcttctgagcggattcaactgtgctccttgaagttcgtactctctaagctggtcttgaggtcgcttgtcccgtggccctggcgctttctgctgacttagtgactaagtcaactatgcgacctgtatctaacagatccaacaagatgatagtaacaattgctcaggcttgtagattagatgcgtatgtacaacagggcaggaccctggtcggcaaagctttcaaaaagtttgtccattaagtgaaccacctgtgaaagctacaaggatttactggtaaagggaatcattggggctctataacctccgtctctacgtctaaatcatctgcttcatcagatccatcgtcttctgattcttgttcaaccacgaggatcggaaactggctgataaatggtacgagagagtttgggatttcggaatcatccgaatcacactccatttgtctaccggcctcctcctcgtcgctagcttcagtaacaacacgaagatagccttaaaaacgttaatgaccaaagctccaaaagataaaaagtgagaaaaggacaaaccgtcttcagccaactcaacctcaggattgcggtgcaggaagttggcaacaaagtccttttccaggggcgcggtatctccattcaggcttagatagcaatagacgaaatccacgagatccattggtgtcatgggagatttggcagtctcctcctctttcagaatgtggccaacgaagcggctttcgtcctgtcgcggcacacggcttcgattcttgcgaggaatcctatgcctaacggttgaatcttgaaggccagctcgtatttcggcgatgggcacattccagcggcgtgatgcgaagtcttctgacaccccaaactgcacattggataccgcggtttgaatcctttcctcgtgggaaagaaccatgatcgaataaaggtggaattcaatgatatacgagtatggccttggaatgtattcgaatgcgcactgggactcgcggtgaggatgttaccaatgttgatgttccgacgcgtcgcgtcccagcgcacggtccattgttgcttagggaagtgagtagcgggcggtcaaggtcttttgcgccattgacttggccaccctatccgacacttatctagacaatgaagttgttaataatcattaagtaacggttaaagtcattatatagaatctaaaactgttggtttgtctggtcattatgtcgagatttgcggttgtcttgagtagccaacgatatacgagtatcaatctattgagaggaggttgtctgaatggaggattcgagaaacagcgagaatcaaggtgaattagctctattaagaaagaagagctcgtcttaaggttataattaataatttctacttatagctacagcttgtaactggttttgtcgcgtggctatagggtaggtaaatctgtaacctacaccacctttacagccacattcaaacggattgaaccattaacgtaaaatccaggcatgctagatgagttaacgtatttgtaccattaaatagtataattataattcgggccctggaagcgtgagagctagacgaccatgccatagcgcctgcactccggcgctgaacacaaataatttctttaaattgctttgctagagggatggtatgtagtccaatagcccattatatctctcccatctaagatccccgtaggattgccattagcgtcgcagatggtgagtggtgggtgtcgtcgccccttagtagtaggaatagatctgggcgtgaggatgatctttgtgcccatgctatttgcagaagtgaagggcccgaagagaatgttgtgcccctcgggtctattagatatagcagcctcaggctgatattcccgttccttctcgagggtaagttcaactaagcagatagctatttcatcgtgaaagcgaaggatgtcgggaagtgtgagattgattagaggattgcgaatatcctcattctcgagttcgtcaaggttgttgcatgggctcagcatgagatgcttggaggttcaagattaggatataataatgtgattagtttcgagggtccaattgagaaatggaccgtattaggataaaacatcaaggtaccgtagcacatgaagcttggatattcttgccgtagtattccacgagatctcatggaagccgtagtggaggcacggcaaatcctccgtgcccggggttctgttcggcagttagatccgcttccgttgctagactcaccactggttgctgaatcggcatcctatgtaagatttatggaccgaaaccgctgaccagcatgtgttttgtaggcttgggggtaagtaaatgagctagtcttcgtcaggtggacaacatattcgactggcaatcggcccttccgattctcagtttcggcagcctttctctatataaagcaggtggacatctcaccttcaaagatctaagcacaacagcacatatcatccacaccttcattctcaatttctagaactccgatattactgctcaagatgcgaatcatcggcgttactgcatacacttatgatgccaacttccaatttggctcgtacaccatgtccggcggcaggaaggccaatggatacccgtcgattgtcgtccgcctacttacggatgatggtatcgaaggatggtctgagagcgcaccgctaggaagtgactatctgccgagtactttcactggagaggttgcggcattgaaagagctggctccacatgttctcggtctggatccgagatccccagccgtggttgttcagaagatggatagcattatgctgtccggaaacgctgccaaggcttttatcgacttcgcctgctgggatatctttgggaaatctgtcggcttgccaacctacaacctgcttggtggtgtcctctgtccttctctccctgcttttacagtaatcggcctaggtagcccagaaactggcgtcaagaaagctctagctgagtacgagaggggggttaccgcactgcagctcaagatcggagacgatccggtcaaagatgcgcaacgaatcagagccatccacaaggcactcccatccaatgttgtgtgcttcgccgatgccaactgtggatggaacctggagcaggctctgatatatactcgcacgctgggccaggatatctgcataccgctggagtaaccttgccgcatattggctgattgtattgaggttggaaaacgctcagggctgcctcttattgttgatgaatgtgtcgtgacaatggctgaccttgtgacagcgcacgctggtggcgccacaggcatcaacctcaagccatcccgggttggtggcttcaccaaggccagaatcttacgtgatgctgctgtcgcgctagggatgaatatcacagttgatgacacatggggctgctcgttattgacggcacagaatgtggtatttgccgcatctacaccggccaataggttgcgtgctgttgatgcttacgctgaatggacagaacctatgattgcaggttgtccaagaatggggaaggatggccgattccagcctactgagttgcctgggaacggttatgggcctatcaagattgagctgctaggcgaaccattgttcaacctgaaagcctaaggagctactatagaacacggctggtaagaagacatgagatataatcatcttctaggtagtctatagaatttgcttcttgaacacagaaacattaaatgcacttgctggctggcctaatgagaagcatgtatacattaacagacggcgtcgctctagtaagctgtctacaggtcgcctccgagcttcttaggtttctattgtaaacatgtagagggctatgataagtaaatgaagtccaatgggtagttcttcggggaaggtcgacgtaagtttgcctaattaatgtgcgcattcccctcaccctcttatatcagaatgcctctaagtcaggactgcaacatcggataacgaaaccgatcaccaagcacatggattccggaacagccgtagttggccaaggtttgaagggtcataccgggccgtcggataacaaaccatgatagacaggcccaagcttaatgaataatagcttttcgtggagttctcgtgaagttgcccgacaagccttgcttgaagtaagcaagtggagaaccggagaagttagaggcgatctaaaccctcaaattgcctctttcagcttttgatacgcgacgacgacacggcccactaagttcccgtttcgggtttaaataagcgaccagcgcaaaggtgggatatatctcgctttaatacctctgaaggcacagccgcctatcgtgcaaccggatgccggcatgtgaataagtcaaactaacgccatagggttagttcgacatgagctagaccagatggatcattcactgactttggatggttacagttttggcccggttttacttcccgtggtcgttgggtctatttccaaattattttgtctctcttctatcctattttcaataattttagttatgtctggtttcacataaatccaaatcaaggatatatatagcgataagcacttggatgacttagaagttcacgtctccttgcagtcagtttatcttaaatgatataggtcgtaatccttcgctggcctttctttcggcatcagcgagctctaaattcatgtttaacattgtttgaaacttacgggcttcgataagttggacgagaaaactttggaaaccagtgttttctaaggtacttatgaccagccgagctggactagaacgggatgggatatgaacctgtccatgaacaataacagttcttggaatatatagggcctaattagaggagttatcggcacagaaccaagcagccgagcctccagaggaatcgtcaatgataccgacaatacagccgtaagagaccgctaccgcaataaagcaaccgatcattgtgtggcctaattaacataaactcattatttgacgatatctgacgcatcttcattgaatgaaatggtgaccacacgatagtggcctacaccaggccaactcgctccgcctgaccgcattagtaaggggcttgtttgtaccctcacctatctcctggttttttttcccatggtaaacgttggactatgaaatgattagaaaattaactggccttattcatgcggccatctctgctaactcaagtttagatcgcgttggtttgcatcgggcggcgtcatgcgcgcttgccttctgacactttgggccagctgcacaccttcatacatgcagcaacacacaaataaaagcgtagattgttgtcccaaaatcaagtgttgaacattatagagcaaaatggtctaaattggatgatcaaggtaccgctatagaggcttatggtataccatgttacacaagaacgaatgggagctcaaatccttgccttccatattcaacccatccatggccgttgatgtcttttgaagtcatgttttggctatcaagggctgtacgggaccgccaacttcttgacaaaaagtcagcggtcttgctcaagatatcggacctccaccacgaattgtagtttctcctaagcctgccaacaatgagtcgctgatggtatgggagtattgacgacatgccggccacgaacaagggccagcacaaaatattatttgctggcgattccgggggtagtgtgttcagtatagagatgaactgctctaggagggtttggactgctgcggacgaatctggtaggctggcatttaaagtcttcttgatatatatcaggcatgcaagtcgatatagctctgaggttacttcgtctgtgcagtcattttcgatgtttttaccagtatgtatgggttggtcatagagttgagcctcgaaaatcttcagctctgtctcaatagcctcgtcgccactgctcttgaggatcgacatttgtaggatgacttggaatatccggcggcaccgccgccccaaaaggacgcccttgcagtgatcctctgaaaggagtgaagaagtaaagattttcgaggctacttgtagaggtaggctgtggccatgagaaaatgccgtcaacgtaaagatgtagtagaagacttcgaacatcaacccctgcagatgtggatcggaaacgatactgccatcgccacagtcgtgacacagagctgccgctgcgtttaagtgagggattattctcccaggggcagagaaattgacgatctggtgaagacttccatgagctaggtcacaagtcactatgaaataaacttacttcgtggacacaaagtagtataatggctaagagaagatcctctagcgaacgtcagtatcgagcttttagatagaacaacaaataaatgacgattgatttacctctgcgaggttgcgcgttccgagagccagaggaggaaatttggctgtctattgctgatcgaatactagctacggcttgcccataaaatccgcaggtcaagctacgcatttcggagctggccggttgatatttgctcagatctccggcggcgacggtcagtatacaattgagaaccgcagggcaccgtatggcgactggaatcacaagcttggaactaccatcggcatttccaaccgacgtcagccataacgggccgttggaatcgaaatgggacaataatctctcctgaactgttgctgtgggtgtgacgaagacgcttacaaggagccgcatcgcttggggcagggcgaagtcgttattttgtcgcaagtctcgacgggcagccggagggccacgaggtccccgagaccaattacacggtagattccttgctgcacatgcggaacagcgaggacgctgctcgttgcattttttcttccgttggcggcattgccgacagccagctcgtgaacgtgtagaacaagattgcgaaggttgcgtattattaggatccggtgccaatattaaaggttccatagtgctctgctccattccgaatggcttgaactcgccaagtacgaagcagaggaggaattgcggggtcaagaactggacgaagaggcgatgtcggcaagccaaggggaatcacgtgattgttctcgttgaaagaccagacgcttggtcacatatcggacatgccggggaaggagatgaagccaatttcttagactcagtagttaggattcataagaccagacctcaatgcatgttttttaaagactgcccgcatggagcttccgagtgatagcagctgttacttaccttactttggagtagctcatcacaggctcacataagacaacacaactgtcatattgtcattttctcattttgtcattcttctatcatgtgttatccttttcattgtgaatcgtggttatggcttctctagatagtcatacgagaatcgtcttgactctagagctagtttcaactctagactgcgagcggcaactagagtgtcttaaacaggctcctgctttttgagtttggtgagaactgccttgatcaggcgacgcatcttcaaaagtaccctttcgtcctcgctaacatgagggaaattgagccaaattatagtcaccaaagcgatcagagctaagataatgggctgcagcacccccacccccgcatgtgaggcgatggcaccaataataaaggggaaaattgttccaccagtccctccaattgccatcgcgaaaccaatggcgctgacgtgaatgcgctgtgggagcagtttggccgtaaccatgacagccccagggaacagaggccccaagaaaactcccagaaatgccacgctgactgcagatacaatgaagtctggtactagccagaaaagcaattgaaaagtgattgcaaatgcgaggtaaaccgtgatacagaggcgctcgccgaatcgttctgtcacgaagccgagacctgctctccctaccgtcatacctgcccagaaagcagtaccagagactccggaagcatatcgcgaagcgttgcggatccgtagcataaaggttacaacccatccaccgataccaactgtgaggcccggaatgagttcgtcgtcgcaaaggaagagtctcggaatcacataccttctgcgcccatataggcaaaaaagaaagcggcacagagccacgtcaccttggatttgagcgcatcgcggaggccaactccgcccttttcaaactcgccctgatggttcatccgatgcacggccccggttctatgccagaacgtgacgagaagaccaacccattctattactgacagcccgacctagaattgtgagtaataatttctatcaatatgctttggacagatatttaccatgacgtaatagaaggtataccatggtaactttcccgaaaccacaaagcttgttgcgatcataggcgcaagcaaagcaccgactgaataacaagcatgcatgaacccctgaattgtgtttgccttgctcataacaccaacccatgcacagaagcaggcatcgcatgctccattgccgaaaccactgaatatattgatgataattagtacgggccaaggtggatgtatggccaagacagcgtaggtgatgatatggcagatcggcgcaataaaggcaattcctctctgtccccatttcatgtggatagtcgcattggtaaaagctgcgagagagtagcccacgaatggcgtcaagaaaaccagcgagactgtggtatagctaaggttgtaatattcttccaactgaatatgttagttatatatctggaactcgccgtgaatagccatatgcaacctacatatgggatcaaagcctatgaattgttgtcaacaaggtcatctcgaatgatgtaaaatgaatgcacgcacgccaacagcgccatcgttcatcccggcgataatgaaggacagaaatgcaaagaccaatcttcctatattggcaaaaggtttattccaatgctcgacctcatttgttccttcagcaatgtctctgttttcggtggatacatcaggcgcttcaacgcttgatgctgtgacgtctgaacaatcgttctgctgtttttccgcggagccggaagtctcgtgcttgtcgttctcctcgggcggcattttgtcaagctcaatgtccaatatattgagttcttctagcaatccgtctcgattcgtatcgtcatgcaatatgtcttggccaaaaacaaagaaccgagaagagtatcttcgattttctgcccggatatcgatcctatacatatatgctctatggcatcccttgcagctagcgttgcaaactaattttgttgcgttaacttactcgagcaggggctgacgatggagaaatagaagacaggtggaacgtcggcaagacgtagccatagagtctaggtatgcagcagtgtatcttgacccgcacaagcggtctgctcgcatggtggtattgccaagtctcgccagcatgaaaggctagaggttgacttgagcccgaaatcaaaccgaaacccaccattagacaccgattttccctacagacccacctactgtgcggttcgtgacatcttctagtatactgaatcggaaaggaatcatggatgtgtaacttggcgtgcttcgacctaatcttgttggttgggcagaagcgagaagtcttcgtgttgttagagacccataataattctagcgtcgcttatttaaagctgaaagaggttagaccatgtacgaaatttgactacgatctacggagtaatattacggactctttcgtatatttccagaacgccttgccttaccatttgaaagagatatagaactcttttcacgatattacactaataaggaattgagaatttatagccatggtctgtattgaatgagacgaggcccggtctttagttctagctgagctagtcagactctccaagttgcaaacagtggttctttatggcacaacaagtgttgcaaaggaactgctatcaaatgtctccgcgtggcatagccctttaccgtttgagatgaaattataatgcaagaacaaattctacattctctaactataaataaagatgatctcatttaatgacttatttgattaaagtccttataaacgccactttagaacaaggtagagcattcgccttcaactccaaatcttcgagactgtacctcttcatggtaaatactctgattcgttttcatgagaaaaagaatttagcattactcaagtagtggctacattataaaccaagtgacttctgcttaatcatgaaaaggccacggtaaagcggtccggcagggaacaacgaggggccatgagggaggccaactggatgaatgctagtcccaacactgaagtctgaaaagtgcctgcgatgatatgaactccacaccttccgtacgggatcggtccgtctcccgacgaagtccgcatatcgggacacaccgacacgtcatctgtccttgcgcaaacaaagtagggaattggttctagtctggcgtgtcctctagacgtactcatgcatcagactaggggatacgggccgctgaaagcaacttgacagaatatcacatcttctcgtcacacattcctagtctcgcatgttccctgctcgtttggctatcgaaaacatcagcgatggcaacgaacgagaaaaatgctggagagctggataaagccaagtcgctggctcatgtgcatggtgtgacgagtatgagaagatgatatcaggcatactgtaagggatgccattcctacaaaatattaatatggggttcttacatgtgctagatacgacgccggcgcttcagaacttgcggttgctcgattcaaggcgcgcaaatggaccatgcactacaacggctttttccccgaacacgcacaaaattccgaggtctctaaagcgcgccggaagcttctgggtgatatccttggcgacattgatgaacaacgatatttacatcgaacccccattctcgatcgattacggctgcaatattaagtttggaaaacggttctacgcgagcttcaatctttgtatcctggactgcaccatcataacaatcggcgatcgtgtcatgctgggtcccaatgtctcgatttttggagcaacacatgagaccgaccttcaaagctgacgtgacagtgtggagttcgcaaggccggtgacgataggggatgattgctggatcggagggcattcagtcatacttcctggggtcacgattggaaaaggctgtactgttgctgcaggttcaattgtgacaagggatgtgcctgattggagtgtggtgatgggtcaaccggccaaggtggtcagaaaggtccaagctatagactgatccgaggactgtatctatcatagcagtgggaaactcaccagcaggtattttcattgggatgccagagagcttgggggcttgggagtacaccaagggcatcaaaagactgcgagaccggcaaaaacaccacggatgcaccatgcccggaaaaatagttacaacagggggcacaacacagacacagatgacaacatgaacgtgaatcaaaagccaatgatggtagaagataacctgctggatgcacatccaaggggaaggcgtcgtgtgataattgcctagcagatactggtgaatctcgacttacgtgccatagtgattgcgccaaataatgtagaactcttcccaattattgtttactcttgtctacaactggcattgcccttaattaggatagtataccttggtctactagaacgtgcaaaagtcgagtaaaggcaagtgttcacgcaagttttcggtattatataacgggttgacgtatacaatagataaactttcaattagctatagagccccctgaagcatagtctctcattgtcatcgagaggtggaagaattctgtgtcatcctttcagcacataatgccaatccatgattcacatccgtcaagatctttatgagggtgtctttaggcgcagttttttagccctttaacaagtctggaggaatacagccgagttcgtggcgcagttgcagtcgacatatccacaggcctgcaagaaataagtaagcctacaactcacacaagtcgatcaagtaaggagtgtcaacctacctcggcgtgtacgccccaggtgccagatctgccatcgccgcagccggatgggaattgatatgggacagaacagtcaatctggttgcagaaaaagtcggcactgcacttgaccgccgccacggtgctcaccatggacaacgcggcgaaggcggcgtagatgattccgttagagtgcatgttgtagtaaatggctgattattccgagttgtattttcaacaaagctagcaattatggtgttgtatagactgagtgaaagggaactacaacagtcttacaacaagcttggcagtatttatattattttgtctcgccacaatccttagctgtgtaagccaaacaacgtcagtccactaagcggctttgacatctatttactacctaccttcttcggcaatataacgtacaggaggatcgatgcaacactaaatggcttacaatcctgtttggtacgcagagcttagatcgcagaccaggtatcccatgtcgcctgaacaatacttcagccaatattcaatgtgaggaactcgattagaattccgaccccaaacctcgtcttcatggatatatgacgacaccatatgatttagctgccacacggcctttctctttttttttctcttttttttttagaagaaaaaaagaaacaagaaaaagagaaaagaaaaaaaaaagaattgatcaatcaatcgttatttgtgagccttgcaaaatctccgtccgaatcagccttatcgcaaacttccactccttaccattacaacttcgcaaaaaattgtctcgcctgtagcgtagcagccctagctatagcgaatgctgctgtgcgcatcgaggagcagtcccatccctgacttatttgaccgacctgtttgaaacagcttaccgatatagtgatccctcggaaacaaatgcaacatcggtcatgggcgcgatcgaacgtcgatcattggacaaagctactcctaagtagtagctccctctggttctgaaacactacttgcaggtggcgaattcctacatcttcaaccccgttatcgagaagggggtgaaagggctttgaactgcccaaaaccagctttccaccacatcccaaagtattaggcaaggttttcaattcttgtgaaagaggatttattacgagctttggaattatggctctccttaccaacagaactatattctgggagtaagtgaaactgaatcatccctgccagcagaagtgaggtaagcgtaactcagctaacccccgtctacacagctgacatcgacgatgctttgactgtggagagtaagcggcactcgatggcaattatccctgttagtataggggtctagaactagtggagaggagcaatccctgccacaagaattgaggccttgacctgttagatcttgactaccaaagaggccgccaactgctcccctccatacgtagtaagtttgaaaggtcgtgctataatctctttgcaagaatagttcaagtgtcgacagcttcaccatgcggcgtagaagctaataaaactagtcatgaaaataatcaccgtttaaagtactggaaaatcaaccacaatgcaatgtagcagaaatagcaagggacactcaaaggaaaggctataaacagggacacgtattagaatcaggttctcagtcagctacctgattacaccaattcttgttgtgggcgtctactttcgggcctctcatagaacggaaatttgcgtggcaacgtagatattcaggcatttttaccacaagacaccgagcttaaccacctagcatcaaatagccaaagaatcaatgacaatatcttggctttcaatgcggaagagagttcgggtataaagttaaacaatagaagatgccagacccgacatcagaacacaatgaatattttggttttcaataagaccacctcagctaatttttgcgtcaaggttctcccccgacctcctagtgaccattacctggtgctactttgaagatctttgaaatccaacaaggagaaccctatattatcatgccagccccaatggccaagttaccaaccgtgacacagatataaagtctaatatttagcttgataatcaagccgatctaatcgaaatacagcaccaagctactgtatctggtttattgccggaagagacaatgggaaatggcttaacaatcaagcattgatagtgcagtttattttatcccttgcgttatatatttggtgatagatgtgtgtagtaaatcaattctatgcaaggcagtacctttggttcttcaagcccttcatctatgaataagtagactgtatcgtcctacgcaacaacacctcaaaggacatccgaccacaacgcgctgggaaggctcaaataacgtgcccagcaaggttgataggaataaattctggttatgtcctcttgtgtattatgagttttgaaaatgcggaaagcgtcaagactttgccaaagagctcgtcatttattttccagagtgtagctacgtgagagcagacctttctgggaaggtctttactctttagtcatatcgtttccaaaatatgctactgtgacatttcatggtgttgaagagcttataaattacagggagcatatcttacattatactagtcatgaataacaacaagaaattttcaatcttctggaaatcgagcttacaagacgattattacaaactaaaaacctatcctccagcgcgagatacgaaactgtagaaacaagttttttttcctactatactacccaactcagtgagaaagcctctcaacctcagcgagcagcgtttttgctgccagcttgccaaggttatttgatgccagcggcgaatcgccagtcaaaacaagccgatcttggtgcgtcgctccggtaatgtctttattaaggggcgtgacaccaagcttgcgaagtcgctcgcccacaaaccaagccatcttgccggggatgtacccaatatcgacgttggcttctttgtccagggaatccgggaagacgtcaatcgaatacccgtcatatataaacttactgcccttgggcttacccacatcggcggcgagcatactagcagggccgtggcacaaagtaatgaagaaacgctgattgtcatgggcccagcggaggacattaccaacggtttccgagaacggtacgccgttcaggacgccatgcccgccggggacgaagacggcgaggtattcggtgtccttggtgaagcccttgccccacacttcttgaaggttgagcgggctacggatcttgtccttgtacttttcaaagatctgcttgacagccgcgtcttcttgtgggaaggcccacatctccagcttgactgggtctcccgagagcgtcgcaatgtcaatgtcaaagcccgcagcatcgaggtggatcatcggcagaagcatttccacagggtgattcccggtggagaaaaactcgcctccggccattttgagataccgctcctgagttccgatgaggagaaccttccatttgccgcctttataggcattagggtagtttgctccatcaaaatccgtctttggcgagacatacttggtcagggagaaaggtgaagggaaaaaggcattggcctcggcctgatctgggacaggagctttgtctgatgtaccggacattgggagaattggggctttcgttgagacttgatgggtattgtgcaatgttttcgattatggctgagtgtgaagggtgcgtaggcatggactggtttcagtgacggtatttatactacctatcaatgaattttgagtttgatcagggtgatgatccagctaaatccagctaagtagagggggagtgtacgagcactaaccaagccgcttgaactcaactgttccgagaccaccgacggcatagcataccgatttcggaaattctgtatgacgatgcaaatacgtatcacctaaggccgctaattttggaagtaggaccaaaccatatcacggacagagactgcaatgcgaacaatcagggcggtcgaggtttcaaggcgccgtcattgactcttgagcacggctacagccctgactacatatctgggtgcattatcgagctcactctccgttaacgccaaagttgggaccctataacgagctgttgtccaatctcatactgatcataaacaccacctcatttcatacataaacgggaaagcacattcaattgatatagtaagacaacaattgggactctaagttctgccggctggtgacgcgcctctactaaacttaccatggcctgatttcctaggacattgtcattcatcagcagaccaaaaaaacacaccaaagcattcaaccaggtgcctttaaaggaatcgcttttgtttattgatcttatatctattagtcgatgattgaatagacggcgagagttaaggtgaattaaggtaactaaaagagtataccttaagactataactaagaatctccatactattatctaaagatttccacctctaaactaggtaataatgctattaaaacttctatatcgccacacaaccccttcaatgtttctcgacagtacttgcgccttctgaggaatttttttcatccagcttatcggtgagactattcataaggttttcatcccaaaaactaaaggccgagcgataggtgatatagagagaggcaaaaatgattccaccaacgagaagcaaaacgtaaacttgggaccaccatccgggtctgagaatggtgaaattacattcgaggcgaaaggaccgatgacaaggcggtgccgcagaacatgtttcatagcggcgactgccctcaccacaagtgactgatgttgaacagcttccatccagatgaaggcttgcagcgaactgcatcatcccgtcttcgaggttgggctctatcgtacaaatcaaaggcggagacaaaagcttcctcattgtctcgcatgccctatagccagtgtaaagtatatagctgatggccgatgctacaacgtcctaaaatgggtctcagaatcaaaaattcttgataagactaggcctggacattgaggatatcaacttaccccatcaatcttaggactttgtttccagaggtgaatagcgagaaacagttgtatcatgataaaagtcgatccccagatgataccgctcggtgacaaatctggtatttctgacttcttggcccaactccttaggaaaatgccgatggcggcgggaacaaggcgcaacattgcggctctaaggtatcttgtctgtagataagaaaaacacaagaagcaaaaccatacttcacctatgatcatctggcgataacatactttatccgccaacaatatattcgacattgttgcttcctgttggataatggtgtcaaaattccagtacttggggctgtaaaggtctaaaaagacgccagcaaggaaagccatgtgccacctataagttaatataagcataaatatgaaatattgattcgggacatcccgtacgtgagaaggaccacggctgaacacctcatccaccataaacggctgagaatcccactcagcttgcaccccaacgcgcgatgcgttatgatcgcaatgccgaaagcaacattgagcgaaagaagaaacacaataaagtaaatccccgccaagagggtcttgggtatgtatttccactccatatgtgatgatggaaaggcaccgctctactcaagtggttgtggaattagcagactgaagccagaatttcacgagtgcctaggctcattttataatgggaatatcttccactaataaaatgtgagctggcgtgatatgggggcgcagacttacaaatgtcccttctccatactgaggcagccaacgtataccgttcatactcacccactacccacttgattcagtacttatgtctggccatgggttggttgtgacatgcttacctaacaatttccaatccccggaagaattaactcgagcagacaccaaaagtccttgtcttaatattgaggagcatttgggtcttaagttcctagggtgccgcctaaagtcctccacgtttgtggcacagcgactgaagttcgtttagtagataattttaaccgcttatgtacaagacgtggtttgctatctcgtaagttaaatgaatatgttcggagtcttaggttaattctgacgcagcgttttaaaaaagaagaaacagaatagtgaaatttggaagatatatataagttaatacagtagcttgactatctttgcttgaaaagatatgaaaggcataatgaggaaagcatgatgtcgtgttaattttactataagatatacctcgtttactttattcttattttcatttcggaggtcgaatagtattagatgatggggttttaaacctagatatctgagactgggagcctagagcgctggtagccctccacatgttccaggctgcatcccagtcatgagttattctctgagctatgattgtaattcgcggatcaggcgtgatgccagagtatatttttcctatcgcacatccacacttcaaatcatcttattcaacctaccaatgcggtcaattcagttaagagaagaaacttagctaaacggctgtcaatccaggcctcgagaagtaaatgcatgtttaaggagaagagtgatattcgaaccataactagatttgtggatgttaatgtaattctcttcttttctttatttaatctaaaaataataccagcgccattctacttgctaattgacgataaatctaatcatatgatgcaacccatgcgaagcacagaacaataaaacgccctcgacttggtgtccttcttgaagcttttgactttatcacacccaccaccttccccccccgagccaattcgtttcctcgtaatattttaaaatccagtgagcctggtttgtagttctccaattttgtggaagacaaaccagttcatgcttgccacaatttctcaccaaagagggagtctgcctactcccatccagtgatctcccactcatcaacattgtcggaaatggtcagccgatgctgatcaatcttccagtaagcgtacagcgatctcgtcgacatggcagcttttctatgcgcaggcccccggcccccggcaatggcatcctcacgacttcgccagaggcaagtagccaggtttgccaactgcgagtctgggctgccgaaccaatatctacagcgcggaagagtcagatacccccattttatccatctcggtgggactctggggggacttacttgagaaaacctccactagcaacagcctcagcgtgggcggccttgtccagctcacccaggttcccgtaatgcgtgtccggcttgatccgagaccggaacgcaacgacgtagaaactcgccttcttaaacctgctcccggattccctggcgagggctctcagctcctcaatcacctccggccagttgaacgactccacatagggggccgtcgcgtagtcctcccggacgtttcgcagcttcgccaacgccctggcgagcaacgcgttctcgttgtcgagggtgtcgaggtccagaagatggtcgaactcctcgtagggcgactggacgaggtagcgtccttcccggggaggggtgccggggatgagctcgatctcaatctggggctccttctcgctggcgagggtgaagtccacgggcgccgagttggcgacctgcacagacattttgatctcggcttcctccttccctgaagttgttcacacaggctgtggaatagcgaagcagtctgaggctccttgatcacttggagcgaacggaaaggagctgctggtttggcgtgtggtataggtgaaaactctatacggcgcgaactttccggttcaagacgcaaagaaaaaaacctctcagtggaagggtattcgagaccgagaggcgttcacttagtcgggcgtgggtggatagttacgagtcaggacagtatactcggcaacctgcgaggatctcgggggaggatttccaatcccttttaacagacggggtgccatgaccggaagtccgccggtagccgggcacgagggcgagattcgtcatttggacgcatggtgcttggtctctcagggtcctccccactccgcccttggacaatggcagtggcagctgagcacgaatcttcccccgtcgtctttgtcaggcagaggcaagacggtcaaggcacgggaaggggcaggggcaaggggctagcccagcctcaagcgcggagccaaaggggaagacagatctagcacgcaacgaggagccaatcggagacgggtgattgcccaattagtgcaaatgaggtcgttggctgccgcggttgcgcaaccgcagtcgatgagcatcatcatggggatgaggaggtaatagtcgctggcagcggtgagctgggtctcatttccaatctgcgagtccccagtcgaatttacaagtcagacactagttacattgactgataacggcttcctgtgagatctctggagacaattcaatctctgcatgtgctgactcaagcacaatctcggctcggctgggaaagggggcagggaaaccctaatacctagacggaaaactctgagcaccggggatttgcaattgacgtttgaaaaactccgatggcgtgcttatcaggcgtttcatgctcctgtctatccgccaaccgtggcttgcattccttggctctacaatgcgtcgaaggaattccatcacaccgtgttatctgcatatgcctcccacgtcgacgtccaactcacccaacccccctgtgatcggaggctgctcattcacacacctgctatatacaaacaattggaagccatgtgcatacacaatgcacttcaattggctggttgggccaggtcctgctgccgcatctactcatgactagtgataacgcatcaagccgaggatgcaacataggtagcatccatcatcgcatgatctacagaagaaaaggaaccatgtgctaaatctcaccgtttttctgctaagtatgcaagattgactcagccaccagtcatctctcagcattcgtctgagtcttgccgagttcgggatgatgccatcaccctggtcaaatcctaattagcacgacttgaaatccccgaatccggggccgagcgagagagagagagaggaagagatcacaaccctgcactgtcactcttgctggccctcctccggttcaaccacagcttggccacgtcgtacgtccccagatagagcccgctccccagcgcagtccatcctgcccggaacagccctccgcgaaagaacccgcggatccctctctccttgtaaacgagccgtgtcaccgcccacgcacccagcttagtcttcttcccttgtaaactgtcgtctccccgtctctcgcccgcggagagcatcatcctcgtcttgaccacgtcgctcggcgtcgtgatatacgcggccaccgcccctgcgctccccgcactcgctccactgaccacccccgtctccagcagctgctgttccctcctcgatgtcccgtctccacctcttgacgcccacagcctggcgcgcaggtgctcgaacatggggaactggagcgccgtgaagggcaggttccgcgccacgagggccgtgtaacccgtgaacagcctcctcgcggaccctcgccccgtgccgagcatgcggaatgcttgtattgatgtcgaggacgaggaggtgggcttgtttgacgcgttgagcatctgggcgttctgtttgatgacctctgccggggcgatgacaaggcacgaggccatctcggcggtggctgatgcggcagcgtgaatgagcggcgtcggggcggagggcgcggcttgggagaagaggatcttggtgttctcgtatgtcgagaagaagagtccagctgcgagattgaattgtgtgagctacaatgaatcgctgtgacgctggtgagctcacctgctggcacggttgcaagaacaacgctgccgatgccctggtagaggcctcggagggccaatggcttcctcaaagggcgtgaagcatcgtgcttgatgtagtcttggctctggtaccgagtcttgatggtatctaggggataaacgagggcatcgatagttaacgctgcaagagcaccagcctgtacgatggtcagcagggagtgtctagcgggcggccgtagtagaagaaaagtaaccgaccgcgtagatatctgtcatgatttcaaggagaagccatattcttctatgtgtgtgaaatggaaaacagggcccagagacatcgggggtgataaaatgtgcaattctcggtcgctggaaatttcatgttggacaagttgtagatggatgacatcatgacgacgatctcaggctacagccaactctaagtttctacacttcaattgtatccaattgagatctgtgaaatgctagaaggaggaatagattggtagaaaatgacctaatgccatggaatcaaatggctatcagccatcggcgtgattggagtatcaacaccaccctccaacccagcaacatcaggacatacaatgctggcttcaagccacgcaaacccttccaacaccacttcatactgttacagtccctattcaactacaggacaaggtaacatcatgtagccacccatcaaacccccgcaaaagaactcatcgcctccatggcccccaaatccccatgcaccgccctctcgtactccgactcaaccatctccatgtactccagcatccccctcgccagccccagcagcctcctctcctcctcctcctcctccgcctctccgctcgccgcccgccctgcatacgacctgaacaaaaactcccacgccctccacgaccgaatcagctgcgccttcgtgtgccggaactggcaccgcagcggcatcggcagcgtactccccgtcggcgcctgcgggaactggaacgcctcgcagatatcattgcccgactcgttgtcgagcactgcctgccctgacgcgtagatctgcttcccgcacgcgtgcagccagaagtcggcgacctgaaaccgctccgggctgatcagcgtgctcatcctccggggcgcgtaggttgtagcgccgtcgcggtactggtccatgcccggctcgatcaagtcgatgcaggggatggcgaggtgggagagctggtgggttgcgacgccggcggtgacgaggcgggcgaggaagccgcagagggagaggacttcgccttcgggcgggaagcccattgagactccgatggtgaagcgggctttggggaggggagatggttagtattgatgatgatggggggggggaagaagggacggtaccatctctgaatatgccgtcgtcgtctggacagcggtgctcgaagtcttcccaggagagacgctgtactcagcatcagtaggttattttccaaatggcccagtcatagatggtgataggtgacgaactacttacagagtcacgaagccggctgagctcggcaaagaggttggcgagccgtccgtggcgctcgtccatcacctcccaggatttggccatggcgatggcctcggaccatattttgtcaaaggcggaaaactcgtactcggagggacttcgcacgaccagacccttgatcttgttggccgcggcgatgggatcgatcccgtcgttgacacatcggtgcatgacacgggacacatcgttgtgggagtgcgtagacatggtgacagaatatagcttgtctttaactttgatgtggttttttatttagatcgtatgtttgttgtatccttattgatcgaggactacggacctagattatatcttcgctccagcaactgatgccgttgcacacagtcacagtcgtgctcgcggcacttccctctctttcgtcacgcctgtttgcgtacccagtggcccgtcccatgtaatgctatgctgatgacgtgccgctagtataaaaataacaaagcattcacttccatgtgattcgtatgaccgatcatgccccccatccaatgtccctttgcagtgaaaatggcaagcctgatgaatccttccgcctatgtggctacttgcgttctccgtctctatgggttagtctatcaagagaagcaaaagaaaataatagtaagatagcagaaaatgtctgaagtagacccaacaccttgtttcctcctcttttcccggcgtaccctgtctatagcatattagaaagcaagcaagaagaagctcagctcgtaattataatccccctttcccgtcggtatctccaggcgagaactataacttgctcttctctggcttaatgtcgtcctggcataccacggccgcgacgacacagatatcgtccaccttgccacctcgccagttctcgtcggggtagtatcgttgcacctccttcgcgaagggcccgtccaggcgggtgttgatgctcgcccgcttggctgctgcgaccaactgtgtgaccagcacgctctgcagcgagacacggttggttccatcacccccggcgctctgtaactcgcacagatcaaacagcttgtcgctgacgcggacacctttgttctccgtcatctcccacgcgccggcgcccaccatgacacgggacgccacgcggaggatatcctggttgaacaggttgtccagcaccccgtccgtcgcaaacaagaggatatcgccatggcggaggtcgtgctcggaaacgtcggcgtcgcggggcaggtcgcagagctgcatgccaccgtaggtggacatgcgctcagccatgcggggcgggatcaggctgagctggaagggagtgttgaaggcgtgcgtctggggctccgagactccatgcacagcgttgagccgcaggtggatgaagcccgagtcgcccaggttggcaatgtcgactgtaccatcaggccgcgcgacggcgacacaggccgtgctaccaccagcgcggaccgacgtatctcgacatactgcgtcatacccagtctgcagaagattgcgcgccgtcaactggcggcctggctcgtcgtcctcgtgtgtctgggccgcctcggccatgtagttgcataacccgtgggagaagtcggcagggtcgacaccggaatcaacccagccgcccacgccgtcggccaccccaaaagcgacggagccggtaccgtttacttggctcacgaagaaggcatcgtggcctgactctgggcggcctgctcggttggcggctctcgatcgagacgggttgatctttctcttcaccttggggtcgaagtggtagacgtgcgtggtggggtggaacgggtgatccttggcaatgaaggatgcggcgatgtggtaggaaaacatattcggagtgcttgcccggaggggcgtcgtagaatacagtcgtatgagggaacggtcgtgcagtgtacgcgaagacgcggccagattctttgtggttggtatcctggagagcagttgcgatcgcactggcgcaagggtcagcagggggaactcgatcctgggcaaagagaggtggtattcggggcgtacattgtgcggcagtccggcagcaagccggagaggccagggccataatcgattgataggcgggcgagttggctgaccggttgcttgctcggcggagtgtactgatttcgagacggtcttcgccaccagggagggagtctgggcgtagggcgacggcgacagataaggacaaggccgtggcgcagttcgtctactcgcactcgcggttcgtctcagtattgatacccaaacaggattgttacaggcgagccgacatggccaaacgaggagagggagcggggagcaatgggaaaaaagatggtttggatgtggtggtccgagcaaacgaggagcggaggcttccggaaccgggagctagcagaaaacaaaggaaaaggataaggggagtggaggtgactgttagttttttccaaaggcctgacgtaggagccgtcctagcgcaggataatgcttaattggtgggattgcctgctaaaatgttcctgatgggcaagtctcccaacaattcaattaaaaagcaacgcctcaccgaagccacaccacaaatttgggcgcggctcaaggcgggaacgtcatttgcagtggttatgtaatcagggtccaggtcttggcatggctgtccggagaagcttttgtccgggcttccgaggaactaccgggctgtcccacctatgtgactatgatcgatcacgatccccgcttccatccaccatgaaccagcgcggagactcgcagcacggcaatcgttcgcccaggccggtttcactatcggagccagccctcgacaaacaaatactacctcacggttctccaaatgatcttgcaatctaagtacccggagccggcgccagtacagctccacgatcagtctcggtcccttgatgcgtggtagtactcggccaatgcaaaagaacattagccggcagagggtacctacaagctagatcgtggggctgctctggtgccagctctggtgccggctccaggtgtttagattgcaagagcatttggagaaccgtgaggtaatatctgattgtcgggggccggctctgatgtagtgattccggcctggacgatgttggtctttcgtaaatcccagtctgggtacaataactcgcaaatatgccatcttttttcatggacatgtggctgatcagagtagaaatccaaagggaggtagcagggtgacaggattgacgcttgggcagttgtgatgctatatttaggtagttagctgaaccgcagttcctaagaagctcgcccacttcgtctgttcgttcggccccaataaggctgactgcacgatttcctttcttactgttggataagtaggtgcgttcaagacaaccaacagtatacggccgggttattttgatgactcgctaatacgcttgtctcgcagttagttccgatagaaaagttgcgatttactctgcccctcaccgttttcccctctccctcttgttccccaaatccatcccaagataacttccaaaatgtcgcctccacccatctatagaaaccgtcggtacatgggcgcaggtggaaaaccctcactataaaatgtgcactttactgatattcgctcaacgggagggtaacggacaattatcgacccggtggttttcacccagtacaccttagtgatgttcttggtggtcgctaccacatcttccgtaagttgggctctgggagccagtctaccgtctggctggctagagacagcaggtagatcttccaaccggctttcttcgtctatttttaatgacttaattccattcttccagtaagcaggaaagacgatatgtcgctgtcaaagtctttggggcagatgcaggcatgcaccaggatagggttgatcaatggttaatgcaagatcaatcccctcacccgggggtggacttcgtagagagcccatccctaggctcattcacagttaccgggcctcatggcagccactactgcaagatgctggagcctcttggcggttcactcggtaccatcctggatgtggcctaatcgtcgtggagagctcaacgagtgtaaacctgcgcagtggaaagcacagaagggcgatggttggctgactgcaccagttaagatgatctgctggcaggtcctatctagactgagcttcctacacagcaggcagatcgcccatcgcgatatccggcctacaaatgtgtttaccgcgttgcaatatgatctttcttcatttcatgaaaatgagattcaaaagtcagtttggcctaccgatgacgtgcaaaatgaggaggaggatgatgagagcaacgacgaagacgacgacgatggcgaagatgacgacgacaacgatgatggcgatgaagatgacgacgatgacggtggggatgacgacgagagtaccatctcggatccccaagaacggctcagacgagaacaagaagaagagaaagacagaaaatggttagaagatttcgatcggaggcgccagaaatatgcagagtttgaagcaattgttgattccaaatgggagacatttggccgaggcgatccgctggcagtgccgcattctgaggaatggaacacggccaatctcatgggtacgcgcaatgatatcgaaatgctcatacgagtggatggcaaagaccctgagccagacgagctccagtacaccgtccggaggacagctctacaaagccaactggatctgagcaagccattcagggttattctaggtgacttgggctgcgccttacccttttccaagtgtgccaaatacacgattggtaccgagcatgtttatcgcccccctgaggatctgctcgacctgaagctcacatacaaggccgatatcttctcagcaggcttcttttgctggaaggtcgcgatgctggatgagctggttgagagatgccaagtacagccgatctcgccggctccatgatcttgcgcggcgcctgggtcccataccctcagagatgcaaaagaactggaaacaggccgatgagtacattgacaaggcttgcaatcccctggatctgtcggaacaggagaagtcgatatatgagaagtcattcaacgagacaagttttcagtggggggatatttggcatcgggcaaagatccagaagccttttgatatgccagagagcgacatgaaggtcttcgtggatttgatcttgaagatgctgcaataggatcctcagaagagaccggaggcaaaggatgtacttcaacatgagtggttcaaggggtgccagtaggaaattgcttttatagctagaaaaattcgtgaactcttcggcgagcaaggaaatatggcagcttttatatctgtgcatctctcttcaggtccacaggcattctacgaatctgtccgtcctgggctcagtccggtcgctaaactcgtctccatcctgttccgctccgtgatgatcaaccagttgatcttcttaattgccctctgctccttatccttcttctcgtactcctcactcttcttctttagttccttctcgtaatcttctctgatggccacgcgcttctcttccgccctggtcagtgccctttccatcttctcctctgccctcttggccttcttttctatctccttccccttctcctctcgtcgtcgattctccctctccgctctctctgcctccttctttttcctctcctcagccttcttctcttctttttccgtccgtctctcttccttctctaccctcttctcctgcttctttctttccttttcttcccgttttgcgcacatctctgtgatgctgtcttccgttgtcgatctgtccatactggcttgggtattggagctgcctctcgagatctctccagcctcgtgtttgaaatcattctcttcgtctttgcttgaatcttgttgcttctttgcctcatctttatctttctcttctcgtatcatctcctcatccgtgctttgtttcttgccatcctttccgaccctctgtcctaccttctcaactctccggtccaactctctgattttcctctcgtacttctcttgtgatttttgcttcgcctccgtgtacttccccagcgactttttgcgcgtcttcatcaactcctcctcctccatcttgcgctgaaactcgctcaccttgacctgcatcttccccatcacagagctcggcctctccacccccggcagctcctccagatccagcggcgagagccactcctccaaatccctcagcctccgccgctgcacccccagcgtctgcagctccatctcgtcgtccagcggcgccagcaccctcagtcccgaagtcagcttgccactctcggcgtccaaaaagggcatccccgcgatcttggccacggcctcgagcttggcgacgcggacctgcaggcccacggggtggaagatgtcgatgttcgccttgcggaggaccagctccgtgcggccctctgcgagcgcgacgtttccaacgtcggccgcgagctcgatcacgcttccggccagctgggccgtgggctcggggaccaggccgatgacgctgccgacgacgccgacggcgaggaggggcgggttgtcggcgacgacgcggttgacgtggtcgaggaagctgaggaacgtctcgcgcgtgatgccgacctttgcgagctccagcgggtaggcgcggatgtagggcgagccctgggcggatctgacggtggggagggcgattggcttggagaggatgtcggtggcatctctgaggcgttgaggcagggctggggtctctatacgccagctcggctctcctgtctcgtcgagggagttgcgcgtgaggcccgatgggttcttctcatctctgatattgagaccggggtggccttggactgcaacttcatacgttggagggctgtagggtggtgggttgtctgctggtaggctcgccaggtcaagggccgcctgatcttcatttgcaggactggtatattggaattcttgttctttcttgaggtcagcagacgtatgagtttctggctgggcgcccatgtcggtttctaggtcgggcaacaggctgctgtatggtcgattacgattgatttcaataccgcttaatagaatcaattattttgaactacacaatcatacagacaaatacatacatcaccatgaccaggacagaccagctatatacacgcgatggatgaatgggtcttgcgtggcttcatgcaccgccacccgccaagccactctagtagggctgcgatctggcccgcgggcaccgcacccgaagccaaggatgatatctccagggtctggcctcacacccacagcttccctgaagggtaatcctttcgagccttcgttgatccatggagatgagccactttgggatggcatcgttcgtccacacgattcggtgtcaggcttcacgaccatcgctgggaagaacctttgtctgcctagctgacgaggccttcaagatctcagtgctattggctatccgttgaagtagttggaacgagtatatcaatcaattattgagatggtagagcgattaatcacgaagcagtagacaccctcttcacgatcgcctcccgcagcccctccacactctccaccgtctcaatcccaaacctctcgcacacaatgagcacattccccctcttccaatacccctcgggacagcaaacaacaaccttgcccggcacgcgcgccgacagccccagctcaagcaggctgatgggcgcctgcgtcgccgggtggaagtacacgaccacgagatccgcctcgtcctgccgcgcgagctcccactcgacctggccgcggtacggcgcgaagtcgacgtcctcgcgccacgagccgtcccagtcggcgcggtacgggttgaagagggtcacgggcacgtcggagagggaggccgcgagcgtctcgcgccagtcgccctcgtcgaccttgctcgtggtgccggccaggaagaccgacttgaccccgcggggcttgtcgtccgatggcgcgtagatgacctgggccattctcggaagtgacgagaagtggttcttgcgggtggcttggagaaatgaacgcttgaggagcagggatggaagttgttgccgaaacattcggggtcttggatcccagttgccaagcagctttgtttgttgggatacttgtcccagtgcacccagcaattgattggtggtgttgagggaccgaaagtgcaccacattcgtttcagcctgtgaggcttcccagcgcataagcccaacagtcatcaaggctgactcgcccaccacagaaatatggttcatatggcagcggcttatcacgtttacggtggcctggggctggaaattaaccagtaggtacagtcagagatatccagtaaagaaggaaacgaaaaatttgcgtcaattctcccattaaaacgtgggtgcaaagatgccattactctcatgtagcgtcccccgtcctaaccttactcttattaccgtaccttatgaacagtaaggtatatattatcagcactcaataatctaataatatcggtcgcagactcgacaataagcagcctaattaatgtttatgtatctcagtttcaatgtcatccacttgcctagcttcatcttcaaacttcatgtttccagccccaaccaagtgctgaatgctctgcgccgtgatatgtacatctttaacaggtaaccatattgccagtgtgtatttggcatgtcagttgggtaatctttgttgtcaggccctccgaaagccatgttattcacccacttacattatttgaagaaaagagaaccaaagtcaactgtgaaaggatgcagaaaccattggaaggtaagaagcgagtctggaattaatagagaaaaggcacaatgctaagttagatagcgagagaaagaaggagaacaaagaaagtttgtacgtgacctgcaggagaaaggccttagacgagaaccttgcacaggacaaagacctcatccatcagtgctttcaagacgcacctgccgtatttatatcactctatctccagccctccctgacaactgactacaatccactcccatccaattattggcgtcctccgaccacgaagagccaagatggcgcgtcttctcctgagcctaccagtagaaattctgcacatgattgccagcgagcttcccaacagcgcgatcaaaaaattgcgtagaacatgctcgttcgcaagcatggtgttccgactccggctcaaccgagtattcctttcaccgcatcagcgcgatattgatgttttctgtgaagtggcccgtagcgagacacttagacatcaagttgtggagttggtttgggatcagaaccggttttgtctaggctatatgggacgtgaagccttattcggccctcttcaagtagagcacgactttgcaacagaggtggttcgtttccagcgcaatcggattgcgaacactggctgtttgacatcggacgatcccactacttttggcgaatctaatacacctctttctcccattgccaagactaatgtagagattctacttcgtcgtgaggccaatgagtatagcaataatgatactttcgcactcgagtacaacatcaaccgctttccttcactaaggcgaataaccatcagccattcgaccaacggctggctcttcgagccattttacgaaacaccgatgattagaagttttcctccgaactttatgtacgatgtcgaccgatacgactacccgattgaaccgttacaacaaagggatcttggtggccggactaattggagtcaatactcaaagagcactcgtggttatagggccatttttcgagcactcgccgccgccaaggagctacagctcgaagaggtcgtcatagagactcccagtggggtcgaatgcggcctcccttttgattttttcgcgctggggattacatcggattatttgaactttgtcgagcttctccgccgcccacaccttcgccgatttgaccctgccatcacagccagcggcgatataccagtctacgacaatcaggcacatccgcctatagaccttttgagagacgcactgagagaggctacatccctgacacacttcagcttcaagttcgatactagtgcccctgttactaactgggttcctctgaaagccttgttgcctgtggatcgctggacaaacttacagcacttcgaacttttctattttacggtcaaacaaaatgacgttgccaatcttcttggtgagcttcccgatagcgttcgatctattgaacttggtttcctagacttttgcgctgaatcggagagtcacgccgggcttcttgatgaaatacttggaagggccttttggaatgaaagagatgaaatgaaccgaccccgtctatgcatctccttgtctgtaagcccacaggcctcgaggagcatcgtcatcaggttggacgccgaaattgagaatttcttatataagcaaggaacgaacccattccgtggttcaggggagcctaatgaagtcgagttgggaattggcacggagagagataccttcaatcaatgcgaatggcctcgtgatcaagacttgaattggcatgaagaaattcacagggcccacacggggctggaaagcatgcttaaggcaagccgggacaaattaaaccgcattaaggatatgatggatgagatggaagttgacgtagtaaggcagggacctcgcttttaactaaacacacaataataagagaataatgaactattctagatatttagcttgatattgtattttaatactaggttaattattctgatattgtgtttaaaatcaacgctgaaatgtcttgatatgccatgttttatttcacccacttgcctacctacctaataaacgacactggcacttttaatccatgggtccagcacatgccctcgctcgccatgttgaagtgtgactgtagcggatcaaataggacgagatacgcgaaaaatgaaacaaatgagtgagattgagcagcgaaccacatcaatcaagcgatgcgtaggctaagcagcaaagtcagcgttggtatcatggatgttaaataggtcaataactgaatagctaaattatcaaagtctcaataacttctataactacaatattctgattaatatgtacaaataagcagatgtcctgcacctaggtatgatacaatatactagttatcgatcctgggggcaaacgatggcgcggagctatggtatatggaccatgtggccaacacgatgacaaagggactcgaggtatcacttcccaatagagggaggaggcgacaatcaggcagtgagggctaccaggtggaaataaagcctctgaccctgcatctagaattcatcccaatcgctccgtcctagttttgacgcggattccgagcttcgctgaagatcaggaatccctagtgtttagctccatcaacaaactgcctcatcagtttgacctggttgacgatgatcagatcaacgccagctttcgtttgaatcttagatatcgtcagcaacatccttggcagcaacatggaattatcctacctcaacgctagctccatcatcgtttaacggtccgtacgatgccgtgtagagcccctgacctctggctagccctacaagtccggagctgtgaacaaaaggctcggatgacatggccacgccacgaagcccgaatctgtgagccaggcgcatcgctgtctgcagggacgtcgctcgcatatcgccggtgggccagttcgacgagtcgttgaggaagagtatggggtagagttgctgcttgacagcaaggaccatgcagatttcagggctgaatgaggtaaagatgattcggcgattaccagcacgggcgtatgtgacggagaggatagtatcaaggaagacgttgatctcggtcgcgtagttgtccatttggaagtcggcggcctcgtacagcatgggatattctagaatacgttttagcaacttgttcatctgccaactgtgtacaaacatactgagctcaatgtccagcggaatgtcctctggcagtctacagaagagctcctcaagcgtgatgaatggttcatggatactatgatgcctgagattaggtttgtatcccgggtaatttagggtgttcttcatctggtcagtaagggcatccgtggcgctgtccaaaggggcacaaagcgacatgcgacgagtgtttcgcagggctaagggacgctcgcgctcgtcccatggcagccttctcctcggctcttcatgccaagtcgaggatgtttgagcatcactgatggcgatgaactaaatgaacatcagtaatggtcctcagagcgctttgataggatgctatcacctgcttataggtcagagtatgcatcggtgcatcagaccccttctctgctacaagaaagtcatggtagatgaccgggacactgtccttggtgagttggacatctactatccgttagttatcataattcctggagcgcttagtaaagaagtttctacctagctcaacgacgtcggctcccagcttcacggccgtgaggaatgatttgattgtgttctctccgatttgcaaggagccagacctagtattttggccgttgcctgctgatgtcagaaaggtttctgttcgtcatgactcatgagaatttaaacataccgcgatggccgccgagacgtgatgacttttcgagggccaatgtttgagatgtttggggaggcgagtgagcaccgtcataaggacgagctatgacaactgtaatgacgacgctgccgacatggccaaatctatcactgacgagcgggacattgtaatcacgaatcagggtgtccctcttgctgcctaaggatgctgtcaagctgccaaccagcgcgacccctgtaccgatggaagtcttatcggccaagttgctgactttcaacacgactgccgcattgtgcggatcgttagttgtgaagcaccaatgccggtctgagttttccaataggtatgggaggaggacagtcttcttctggtcgctccctgctagagagatagagagctctaggctcgtgtcgtgaacctggagcggcgagatgcgccccttgtgcggtgcaatatcaaccgtgggggtagtccctttccacaggtccagcgtgccgagatggatgaaaatgaccgactctgacgcggaccgctctgggaggatattgactgcacctaggcgttgatgagactttgaccgtagcttggacgacccatcagacttgacggcatcaaccactttcatatgtccgcggtacgccgcatggtccttagccaaccacccccgataatcagggatctcagctctggcgccagactggatcagcgcctcgacgacggtatggtgtccttgcacgctggcagtggtaatagctgtccatcccctgactctctcccgggcatcgacgtcgactcctagagcagcaatgtccctaaccaactctgcaagtccctgctccgctacggtatgcaatatggtgttgcctgaactgcccacaaaccgcacaccccagcctttcttgatcagcaaacgggcgacgtctggagatctggaggctatggctatgttgagaaggtccgtcgtgtcagtcgactgcaggtgcccgaggcagtccggagtctcgcagacttccaggaggagcgcccccacagccgcatagcctctttgaacggcatagtctaacggtgtcaagttcaacttgtcaggactgaggcaaagcttgcccagcggacttgcgccggccgagccctgtaaaacggatattatctcgcggcatactccgtcaaagccagagagcgcagcgtagtgaagaggtagacgccccagtctgtctcggctgtgcaacagatcaagttgacttgggtgcagcagcttcagtatctgaccaaaactagtcgtggcggaggaactgtcaagtggtggatcagcccgactaagatgctggatgatccattggaggcagtccggaggtgcaaaggcatttggtttgactgagctggaccgcaggctcttcagaagcttcatctggcagctggaagatccacagacggtagcaacgtgaactaagctgacgatggcttcctgccgctcttcagaggagtctgggaaatgttgacataaggcctgctcaagttcttctgcatcgtcgttgtgtaaacagcggaggatgtcgggggagaagcgatgcggaaatcgaccaaacccagactgctccagtagcagcgatcggtaagaggactcgccatctgcttctgcagtcttctgtaaagcttcttggacgtgctgtaaggtcacgttgacttcgagaagagctgagcggcctttccgtgggtgtttgaagttggcgtggatattcgtaacctcggcgttagtgtacttgattgcagccttgtcgagaatacgcaacactgcgtcctggttgaccctgaagtaagactccaatttggcgatatgatccgcaatctccaagagcgagaccttgatgtcctgcagctcggtgcatgagacaccctggcagtcatggagcacgcgatggccaatccgaatcccccaccgctcctgaaaggccaggaactgtgttttgatctgtacattatgaaacgctaggaacctgtccacaatgccgatttcaaagcggatagcttctccgagttctagtgcaagcgagacaattagccgcgaaggatatcgtgggaggctgccttcctggacttacctggaagaagcgactcagcgtcggcgaaggccttgaggcggttgtagtcgacgtaagactcagttcaggctgggacacacgacagatgcaagctgttgccaaatcgcatgttgtatctcgagccttgtttatctcggtccttgtagtatctcggtccttgctgtatatcgatccttggagacttctgctgattcgggggcgggtcgctagcgatatattaaaggtagtagatcatgacggaggtgtgatgggttaagggagggataaagagatgggaaacggccgaggaagcacggtctcctttgtccccctcagcatttgactaccctcatcagcatccgacgaccaaggcgagctaggaccccagacgcgcattgtcatccccccagctaagcatttgataccatcctaacaaccatcctagatgctccccttagtaataccgccgcttaattccctggaagaggtactacgggtggcccaacgacttccaggacaaagtcgtctctgccaaaacaattctgcggtctagcgtggatacagccgccttgtatgcgcaattcatcttgtttcttgtcttctttccgcctcgctgcttgtatactagtgtcttttgccttttctgcatctcctttgcccatacctacatcctcctcgttatgaagttgtaagttaactatacactaagatgcttgaatagtgcggtatggatggcagaacaccccttactcatgcagtgagaaccgacaacatcgacttcccctatataattcttcttaagaatatcgacctcagatcatactccactgaccacggcgatgtcatgtcaacaatacactggccacagcatgcttagccttttgtgggacaactacagcattgacctcgccctaaggggcttcgcctacttgtgattgttgcgcaatatgttattgagagtccttagacccgcctgttggcttcattgaaaagccacataataaactcgtgcagtcttgacaccataatgatactactaaagactgaccacttcagactcaagcacgacgcagtgtatagcaccggcgactttgacaccctgctctcgcagcgtcccgatgtgactaaggagatggaagatatttttgcccagttcatgtcattggtgcgaaaccaggcgacactacagacggagcacaaagagaagatgatagagatgccttacaggtcgagtcttgacgaagacgtagcgttgtcggatgttatgtagtactacttggcaagctattatcaatggatttatggcgttaggccgcattttagtactggatggcgaactaatatcaatgggcttgtggcattaagctccagacttcttgagtgttgggactatgcttatgcgccccccgatgcaaggggccaggaatagcttcccattgtctcgtcgcaatcaagagcagggagcaaaaattacagctgtatgagtaagcctgctaagacgaactttcaatccttcagactacacaacagagaactttctccttcaatcatcatcacagttgcttcaaattgtttgcttgtttttgcttcaatgcggctgtatgatcctgtcaatccacacctatgatgggcgataattggcagttgaggtccaagatgtgctcatgatatgatacgaagtacattacgcctgggaaggttcccctcagaggcctaaattcgctctgctacgcagtatacttcactcatttaggactttgcttgaccttatgtgatacgccgacttgaaggccaatttctctaagtgttcaacatcctatcggcagtagctgaagcctggccttccagcttgagtttgtaagtgcttattagtatttagtactattgtttgccgttggctggtatgtcattattcctaagtggtgtgcatcgtgaaaccgaaccgacgcccgcaacggctataggttgtatgcatattttgggccgtgctacttttcttcctacaaataacgagaggctgcccatctttgcctgtactacttgtcacatgttttcaagttgggtgtccctgttagtgcatcgaatccgaaagtgaaaacttgtttcagacatggatcttcttcttaggaaggaccgctatagcataggatatattgatctaataaccacctttacagataattcgtatatctatagagagactattatacaaactagcatactaataactcaattctaaaattactaacagctatcttgagtttgatgaaacagccgtgaaaatagtaaatccaatcaggtgatcatatatagaagagagctacaggagactgtattactcacagcagcatcctctcagcttcatgcctcccagtattctcagcagaccagctagatgagacctcttccgccctgtttgtagcttccataagcagggaggacacccgcgatatcctccattccacctggcgggtgatgcccagactctcaggaatgcaaaacggccaagtattcatccttctttagtgtcacacaccactcgttcatcgacctggtttatccgcatccgaataccatccatccatccagtcatctcacacaagacccgttctcaagtctcgtatcgacctcgtgtcggaaatataaaccgaaatgtctcgctcagcaacgacccctcattccttagccagtgtctctctttcagctccgacaagcctcttacctcaaacaagaggaacctttggccacgatcaattcacatagctcatactgcatagcccgttgcggggttatgaaaccttcccttcatgacaggtcaacgccccgcctaacggctgtcataccaggcgcatcttgccactgacaagcattaacattcgtttctataagtcagggccccttccgcctacttcaagccttctcctacccgccgctgtcaggaaccaggattcattaacacctagttaacagtccacgttcacatttcccatcatagcattgacgttaaaatcggtccctctcctacaatttcagagctcatccacccattgacacccataatggccaaacagctcctcgtcctggctctcctctatgccatctgcacagaagcttcgccagtagggctggccgtctcaactccgctgccccaagcgacctcaaccaccttgcctccggctcccacccctcccacaaagcccgcctttgataccgccacgactgatcccacgggcttgcctcccacgcctacatcagacgactgcagtactcgcaccgtctgcgtcgacggcatcaacgagtgcggtgaaccatggggaacgtaagctttgtctcctccagcccagccccttcccctcgaagtctctcaccactgaccttttttctccagctgtatcccagactgccaaccctggaacatttccacacctccctgctcaacattcaccccgccccccatgtgcaccgacagcgagccaggccagggaatctggctgtgcaaggacttcatcgacccctgccatcagatgtacggagggtaagttgatcaaacgcgcccccatcctctttcttttgccagttgctgacgcgtgaattggacacaggtgctacgacgtgtgcaagcctgagccctcttggtacacaccaccctgtgacaagccgtggccaacggacggtaatttctgggcgcctgagcccacgccgtgggagcctagtgaggcccagcctgacccggatactgggctgtgggatgggccaaggccgatgccgatgcctttgttggagtagctgtgtggttctaccgggctggaggattgggtgataatatggtatacattgaactaaaaaggtacctgttatcatattaagtgaaaaaatcgcacctttcgccacgtacttgtatgggtattgttccatctggaaagacgtatcatgatgtcgtaccactctcggtgggagaggctgtgaagatgtaccgaatcgcgtcttcggaactggcctgggccccatcgttgggtacacctgttgcgtgtgattgaacacgcaaagcagtagggtggaaggcggctggcttggtggtggaatgaccgttaggtgcgccatcgactctcattgccataagcacgtctagtttgttaagatcaataacccaaaagaattgcagagcaaacatcatggacgagcaatgactttgtcaccttctactgccagcgagggtgaagtcgtctacatatcgattgtgtgcgtacgagagaagtgcgacagatcaagcctcgcagtgctaaaccgacggcaaatacatacacggtgaaaggcagggtcttgttcgtatatcgattgaggctggggattaaaatcaaggaatcgacaatatttggagtaataagatgaacgaagcagaattttgctattctaattttcgtttggatagcaagaggaacatgagggtgaatcatgcacatacgcatgcgcatccagtctctcccttttctgggtcaacttgacctcaaattgcaacaggtgccaaaatttttgatggacatgactcaccttcccgtaaaatcgatcagtccggcaatcggagtaccatgcaagatcaaacatatcgccaggttatgtcatgtcgtttggcagtacaacaagacgcatcaaaccgggtttaggaagtaggtggcgaatatgaaaacgctcgatcatcaggcagagtgagttccctcgctgcacggcataatcattctgccacctgtatttcattgctggtatcctagcccaatggcctcgcatgtcgcatgcagttgcgctgattatgagtactaacggagcgaagctctttggattcatatagcaccgcagaacaaatattgatgcattatttgctaccaacctggcatgttaatggtctcagtgatgaggcggaacaagttctttcagcaggttgagtggttcttcatactcgaaccatactcagcctgagaagcagtcgagacactccaaaacccttgatcaccatggatcaaaagccaccactgacacctatggtacggatctgtgggatcggacctcgaggtatcataccatctgcacaggtgatgtccatttcaatgtgttctcatcccctctcggctaaaaataagcatgcgagctcgtagcagtggaactccgttcataattgtcagaagcaccagggaaggcgccgatcggggtaattgacgagctccggacatcgtcatctgagctcaggtctggtccaaattcatcatttccctccggcagggctcgcatggcctcgaggacgtcgcggtctaacgtgggaggatggtattgggcgattgtgtggatgtcgcgaccagacgggatcttcgccaacaatgaattgatagacggtatcactttcgtgttcatctagattatcagattagtgatgatatgcgattactttgatcgtttggctcaccgtatcgttgatcttggtccatttttcatccagcatctcaagaactctaatttcttccaatcgcccagcgtctgcgccccagccggtttctttttcgacacggcgatcttccctcctctcagaaaactccttcttgaaccggctgagactaattcccttcttggagtccttgacctccacaccaagttcctggagcccggctcgaagccacccaatgccatcagcggtctggccaccaagctcagcgtcaataccaaggaatctgcaggcctttgcgcggctggtgcggcgaaaattctcaatgtattttgcaaggccagactcgacctttccagtcgggccagacccagtgggttgggccaaggaggcagctttagcagcatgctctgaagcagccagacaaagacgagcatacaggtgagcccgaaccttggggatctcaggaggcttgaacatccattccttgtcattcttgttcctatcctgcgcgacagcagcgggataaggatcatccttgagaactgcaagcagggtggcttcggcatgggccagagcagccagggcacgaatcgtagttggggcaatgtcgacacagggggggttcacagaagtcccctcggttctagtagcaagataggtgtatatagaagcagcttccatcaaggatttcgccgccgtagagaccgctgcggtgcgctcctgcgggccaaggaagtcgtggttggtggcatagaggggctgcagggccgttcttgatgccaagacgtgtgtaaaacccagagatgagagcgtgaaatatatctcgtgctcaatggagttgatccgcgcccgggacctctctttcccaggcacggcgtcgcctgagagtgtcgtacgccatttgatggtgggtgtgcctttgggcttcacgtggatgacgtcgcctgtggggagtctcccatcacgaagtccagcgtcaatggccagaagatagggaatgtagctgttcaggctggctgagactgtcgaaagatggccgatctgctcagaaggagggagacgcttgtgtttcttcagggcctcacgggcgacgccacggtatgtgctcgcattgagtggcaaggaggggtgagtctcgcactcaaagtgggatgagaaggaaaaagacgacgtggtaggaaggacaaatggataaggcatcgtggatgattctactcagatcggattctgaccgtactccacgcaggtaaggactgtacaaggccctcatctattaagcttaacatttgagacagagctgacagaataacgccaaccggttggtctcgtctcattcacgtcaagcacatttcgaggtgcgggacaaaggccagtgtgagggtcaccgcatgcactgtggctcggctctcgcacaagcagctgcttgcgcctaacgagtgttcacagaggtcggagcccgtgcgcaaagacgtaatgacactgtgtgagctgcatgactaagcacctaacccagacatcatgtcgatcagcctaacctagagggaccagcttccactcccgcaagttctcattggccatcgacccctgcagctctcctgcgaaatgacatgcgcaggcccagggtagctcattgggacacgaatccatccatctcgcaccacgaccagcaacatccacaaacaccatcgattgcttccaccgggcattgatgtagacaacaaccatggctggatcgagcccgttaccccacaagcccaggcgcaagggcaagaagcccggcagcgcaaccgagaagcctctgcgaacccgcgtcgccaatgccacactggtcagggctccctcgtttcctctcgcggcgttcctctggccggccaggagatcatcgtcgcaatgggaggtcctacccttagtcctgatggtcgtcggactcttccgctggtctgctggactctggggctattcaggtaagccatcgccagccatccaactggacacgagctccggctaactcagcagtcaggcttccaacgacctccaatgttcggagactacgaggcgcagcgacactggatggaaatcacgacgcatctccccgtatcgcaatggtatttccacgacctccaatggtggggcctcgactacccccctctcacggcctaccacagctgggttctgggcaaagtgggagctctgatcaaccctgactggttcgcactctacacctctcgcggcatcgaagaccccaacttgaaggttttcatgagagccaccgtcttcatctccgaatacttgacctacgccccagccgccattgtctttgtccgacgatatagccgactcagctcagtctctcaatggaccgcctccgtcgctctggtcgccatcctgatgcagccctcgactatcctgatcgatcatgtccacttccaatacaacaccgtcatgctgggactggtcctggccagcatgtcgagtatgttggccgagcgctacaagtgggctgcggtcttctttgtcggagcactcggattcaagcaaatggcgctgtattatgccttcccggtcttcgcatatcttctggggaggtgcattttcccgctaaatatttcacgacttttcggtatcaccctggtcaccattgtcagttttgccgcccttgttttacccatcgtcctcgggacctactacgatgtctaccgcaaagtgaaccctggaaacgaggcagatggccccccttcagagcttcccatcttcacagcccttgcacagtacctagatcccaaagccttctactatcccatcgtccagcagatgatccaaatcatccaccgcgtattcccctttgctcgtggccttttcgaggacaaggtggccaacttttggtgcgccttgaacgtcatcgtgaagcttaagagctttccagtcgaactactccaaaaaggtgctgccgccgctacccttctatccatcatccctcccaacctggtcactttcattcggccaagaagggagatcctcccccttgcgtttgcaacaactgcgtggggatttttcctcttcagctggcaagtgcatgagaagagcgtcctccttcccttgatgcctatgactcttctcctcgcagggagacagggattagagtgggagactcgggcttgggtcgggttcgctaacctcctgggtgcctggaccatgttccccttgctccagcgtgttgacctcgctgttccctatggagtgctgacgctgctctgggcctacctgttgggactaccccccactacctggagtgtttacaccgaaggtgcgatgacttggtccaagatcatcacgcttgtgacccacagcgttttctatgttgctatgattgcatggcattttgtccaggcatacctcgccccaccattggacaagcctgacctatggacagtagccaatgtcggcgtgggggttgtaggcttcggactctgctacctgtggtgtttctggaaactggtttcccacagtgatcttgtctcttccacgaagaagactcaatgagagacatcacattccttctcctcctgttcttagacgttagacaaagcttcctgccctgaaacacagctgcgagcttgttggtgatgtcttgaagctagggcgaaagggagctggacagcgttgaccccacctctcttccctctcttaccccttccccctgtcccggttgccttgtaagttacgagaagcggaatctgccctggagcaagggcgagggcctgttggccggtggtgtagattaatgataccctttctcttcagttggttcaaaagatcttgatttgtttctgagatttgatgaggtttatgactctgtgatcgccccccccttccctcctccacagttcatgcataagcatgttcgttatacattcaatcaatgcattaacacgcctactacgcatccaatgaggtcataattctaaaccaaagcgatagccgagtatgtgtgtatagccacatcaggaagcgggagctcatgcctcgtggctgtagacgaacaccagatgacgcctggcacaaccaacaagcccgtacacgccgtcagctgcaaggtccagccccggaagttattttgcaaaaacagctttccgtaaatggacgaatctgctcgcttcggtgcctagatcttccccgaagagctcttggccgcacgcgctcggcgcctaaatccatgcaaggctaccaacacattgttggcagtccaccaacaccatctcccctacttcaatcggccacatggttttatgtccgaactggttcatgactcgcttcatttccaattctgccccgttccatttgcattcgtgacaaggctggtatcttgagtgcggatattgtgggctgtgggccataccctagaccccagagtgatcaatactttattcttctccccttcaacacaatggtttctttcttattgtttcatggatcgagtggactttgcgaagttcttcaaaatcgccggtcatgaatatttcctctaaacgagaatggtaagtgtgatgtggattaaggcagagttgctgttgcttgcctccttggcagcgtgacgaggcgatcacggccacggtatatcttctttttatagaagacactccgaggtttgttgtccctctcctcagctgtcccagatgtacgtgacattctgtcccagcttcaccttccttgcgtttacggaaaagctctgatgacgatgaagaggcacagcattttcctcgcattgcttgtgacaagctgtctggccctgacactctcacctcgcgccacagcaacagcaaatgaccctgtttcagtttcacggacgttttcccagagtagagctacgcatacaatccaagtaggaaaagtaagtctagtgttacccttctcgatgctcccaaaaatagaagcttacaagagacctataagtctagatacatgattgaaccacgcgaggttattgcagagcttggtgattacatcgagtggcagttttggtcaggtactcaccagatctcgagaggagactttgaccacccatgttctccctacgaagactttcacatggatagacagggcttctcaagcggagagaaggtggttgagacaccgggacaagatgtaggccggccaaaacaacaccttattgttgggaaattcttgcttacgagtggaaatgtagcccttgatttttaggctgcaagtgaatgagtcagaaccgatgttcttctactctggcagcaatgatgactgttctaagcacaagatggtcgtagtcatcaacccggtgagtcgtttccaagagatgtgtcattggccgcaatactcataccagtcaggccgagggaaagaacctacgtttgtggaaccacagagcctggaacttcacggtgcaagcccgggaagagtcaagggacgatgaatcgtcgggggttctttacagccgctcctgcggtgatggcgacttcatccttggggctgggcaagtcgtggggattgccctagggggcgccgcagccattctcatcgcgggattattgggcttcttctgccatcggcactcagtcgagaggccggtaacgtccagacatatccggcggagctcctatcctgtgcactaccaatctaaatacacagatcctgtaaatcgacctcacaggccatcacgggctgcagcaccccgaggttccccgtcggagactgggatccgaaggggatggagtaactcactgaggaggcacaagaagaccaatgtcccacggcaaccccgcgatactcgccaacttccctctatcccatctcaaccccctgcaagtgccttggtggcgaggaacatgagccgcccggtggccagtcacccgatacacgaagatacacgactgtgagtctccctagcatgtatgagccactgtccgtttgagtcatactgataggaaccaatgagccagaggaaatccgacaagagaggcagaggcacgtgacggttcggctgagataccggtcgtattctcaccaccaagccctgtcgagctcccttcgcaatcaagggattggctatcaacctacttccgtccgacgagcgtcagcttgggcctagcactgtcgccgaatagcaaccgccagctatcgtggtcaggtaatgaagctctgcagcgaccttcaccagtttaagctggggttctagttttgtgcacggtggggacctaccctgcgagccaactctgtcgtgattccttttttcctctcatggtggggggaggggtcaatttctgtagggtcaaccatggtatggtaaaagtcattagcgtgatagattgatcatctgttttctgctgcgctttcttctgctgttccagttggtcttagtgtctatatctttactgagatgcttcaacaatcatcacacatcactcctgattgaaggaaaaactagttcgaagtaggcaagccgtagttttattttcacaagccgagggctacgtggtattcccatctaacccgaaaagacacctttgactcccagccatgagcgaccgcagccgtagctgcagctgcacaacctagcccatataaccttcgaaatgagtcttgacatttgctcgagacgagagcgcttagtcgaagagaccgaagcccatgtcctcatcagactcctccttctcctcctccttctcttcctcagcggcaggggcgtcaccaccggcggcagcagcaccaccagcagcggcggcaccaccggcaccaccagagggaacggaagcaagcttctcggaaccggcagcgatgagctggagaaatgttagtatagggttggagatagaggggatttgcgccctaggggcaattgcattgacgtacctcgttgatgtccttgccctcaagctcggagatcagggtgtcgagacggtcagagtcgacctcagcaccaacggactcaaggacggcggtgatgtccttggcggagggggaggtgttgccaccgaggctgaggaggaggtaagcagcgagatgcttcattttgattttgttttatcctggatggaagaaagtttgtaagtttaaatttcggtacagtccagagtctggaattggatggggagagggagaatctgggattcggagaggggactcacgttgtagatatagaaacacgagaaatcaatcactttaaccgcaaattgggcggagactgaaaccttcgagttctggtgaggttggttgttgatgaaaaggaaacgaaacaagccgcgatgttcggttagaaatgttcttgtgaattttgtgtgggcaaactaaaatcaattagggcgggactggtactttgcccatgtacctttttttcgcccttgttcctcccaaacttttgcaggcaggccccaccttgcagacagggcaagcgccaatcggggggttggcaatgcaagccacatcccttggcgataatgcctgataagaacatgcttcagccactcacgtgccctgttgcgcccaagcaaagctgtggcttgtccagtgaatgacttaataacggcacttgctgcctgtagtgacgcttgttgccaacgacaatcccgttgcttttgttctctcctcccgtatcaacctcctctcttccccctcttttccctcacctgcttcgccagcattttctgctcatttctatcccgtgcaacccttccttctttttcgagcaatcgtcacatctcccatcacaaggcttcggaagccgtccatttcgagcgccgggactaaaacaaaactttccgaacggtcgcataacccgaaaaccctcgcctatcaggctcccggcgtgtgagccataccgagacccatccttcctccgtcatcgaggacccatcagagactctcagggagccggatcctcgtgtcaaacgcatacaccgatgactcactaacgaaacacctggtcgcggggcgtatttttcactgctgctgagtggctcacaaccaacacatccctccacggccgtcttcgccgtctgattcacgatggctgtgagtaaccaggcacccttggttccccctcctcgaactttttcccactaactttggccacctttttctagatcggtgatcttctagcctccatcggaggtggtgaacccgcacccaagcgaaaggctgaggaacaactccaaatcgcttccaaggctccacgcataaactcccccacagtctcgcgacctatccagccatcgcggccgcttgaccggccaaactctacacagtcgacgaatggaaacggagtcaggtcgaccgtgtcctcggctctgaagccgaccaacggcacacacaggatcactaagcctagtgccccagtccggtcgttgagcaatggaccatcgccagccagtgccgccgcgtcgagagcccctcccaagaagggctcgttcgccgagattatggccagagccaaggccgcccaggagacgatgggccaggttggcaagatccagcacaagaaggtagagaagggcgtcatgaagaaggagaaggaggtgttcaccaagcccgacccacgagccaaggtcgaccctcgcccggctggaaagaaaccggtatcgtcgtcgtcctacaccggcacttccaaagcctcggcgcgacccaccgcgttagtaagtagttccagagacccctcccgaggcaagccagcggccaggccatcggatcgggacaggaaacaacacgtggaggaggtggagaagaagcagaagaaggccgcgacggcgacgactggttacactgggacggcgcggcccaagcctggcagcagcacctcaaagcacgacaaggctccccggggcggagcacttctaaatagaccagcccctcgggccggcgcttcgagctattcgcgttatgaggacgattatgacgaagagctggacgatttcattgattacgacgatgaggaggagggcgagccacggtatagatacgactccggttccgagtcggacatggaggccggaatggacgacctggaactcgaagagagaaaagcagagtcgatcgcccgtcgcgaagacgaacttgagcagcgcagagaaaagcagctcaaggctgaaaaggaggaccggagacggcggtatctccaagggcgttaggttggccattgagaatgtttgctctatttgacttcttctctgtttatcggcagcatcactaggggagtttggcccgtcgtaatgttttttcccccctccgtctggataattatttccacgtttcccccacgttttcccctttacacacaacacactcttgtttctggttttcggttgtttttggtacccatcagcgttggagttgtacacttacttgcgtttccgcctgcctcattcctcggctattcctggtttttcccttttggaacccttgcagacaagtcgaagcgatgctgcttaatcatacatgtcatggatgatgaatagaggagaatggatatggtgcggtgaagggggtaacggattagattattcaccttaagattagcctagtgatacaatacaaatgacgagcgtgctctgtagagtacgctacagacagacagatacgagttcctcagtctagtagtgcatgcatgcatgaatgtgatttctgtcaatttaacttggatgaatcgtgttcaccatctatgaacgacccaggccatcacactgccaataccagcagctctaattagaataagttcaactcccaatacttgcccgttcaaatagaaaagcccacgaagcgctggcctaatacgactggtgttaagataaatagatggctagttcaaccgctgagacctttcctcgcaaaagggaacaaaaaaaaaagaggcaacccataacaatctttttcctaataagggggcaatcatggtaaagtctcactttgagatgtcttggtgctcgaactgccatatggcttcaacagccaaccctgatagtgctttagcccttgggcactgatgctattagcgttgggaatgatggatggtggaggcttactccgcccgaccggctctctcttaacaggcggagggggcaaagagggaggcgcggcgggcaggaggcttttggaagacccaggtacgggcactggcgcgacggtcttcttttggctttcctcctcggcggcctttgtcatgacgccctttacacggaggtactggattgatgcaaggatggtcaggtcttcctgttccttgtcgtttaggatcaagcgttgctggattgtcaggcgcccgttgttggcctcgcgctccttaatcgcggcgtcgcggacagcagggtcatggacgaagcggcacttgctcttcttaccacaggtcccaccagttgagaaatacttgcagtgacgagtaacatcggctctcttgccaggctgcgcagcaggggtaggggccgagttggaagccgggggccgagaggagacctcctccggcttgtcgtcatccgacgactcatcagatgacgggtcgcgcatctcgtctccctcatcaccttgttctcgctttcgtttaatagatgactccaccttacgaagctggcgtctcaacttatcagcctgtctctctagtgatgtcctcttttcttcattcttctgggcagcctcggcggccttcttggcctctctccgagctttggtggggtagttgcgctttcgttcagcaataaattcggcaatatcgtccactctgtatagatgttagaaacctacgacgctgtgatcaaagtacagaatacgtactggaacttttcttgtccgagaagcttgacgagggcttcctcttctccttcgtcgtcctcagtctcggactccatcccaggcgtcagtccaagagtgttggtctttctcttcttcttcctgcccacaatgggtagctcacgctggccctggttttgtttcgactgttggttttgtttttgctgcgagctcttttgttggccatgatgacccccatgatcgttgctaggcttatgatgactgcgccctcggtccccagagccgtgtcctcctcgacctcggcctcggcctctatttccttcaccgccacgacgcccatggctattgttatggccgtgacgtccgtctcggtgcgaagattgtgtaggaggaggtggaggacctgagtaatagtactgagagggaggagggtatggctgcgcataaccgttcactggaacagcgggaggttcatgttcataacggacacctggggagtgttttgaccctccacgaccttgatatcctcctcggggtctgctatccccgtatggcgcagaagggacatgtccttgaccaccccaatgcggcgggggtgcagagccgaccgaggctggggggtatgcttgaccataaggctgaggctggccatatgggggctgctgaggatactgaggagcggtgtagggctgggcagggtagttgggatggtaagttgaagatgcgatcggggcttgagggtgggcgtgtgcatgtgcatgttgtgtagatggatggccgtgctctggagaccattgctgcgtgggagggtagctgttgtaggcggggggttgttgggggtagtgttggctggagtgttcatagtgaggcggttgctgggacttgtactcggagcgagcgttagaatagtggccacctcgaccacgcccattacttcctcctccacggctatacgaagaattgggattctgcccgtagctaggacccgaactcggggcgggaggaggcgggggcggtgcgtagccgtatgacgacatggtgatggtccaaactggactcgatgccgtcacggatgttgaaactgtgttatgcgaaggtgcgagctgaatctatcggcagagccggctggcgaacaagggggatgagggcagatccggactccaggttgtgtttggtggtgttgggcgaagcttgacaagaacgcgcagcagttgggtgctggggatagggaaagtagaagttgatggaggcaagaggtaataaacaggaagaaactacaccaagcacacctaacaggtcgaccaccgcagctgcgaaaggaaggaaaaccacaacattacctggctggtggcaacgaggacgaattaatttgacaaggctgtctgtccaaagggaagccgcgctttgtctggtcgctcctgctgtgaatcagtgagagctgatccgtacacggaaagcggtgaggttcgaactaatccgatagtagcctagcgcctgcatcaaagttcttttctgccgaggaatattcagcgacaaacgtcgagcaaaagtcgctttttgcaggcgaccagcagaacattggtcattcgtgagctgctcgcactgactcacctcttcgcggctccagagactgggagatgacgcctccgtccatcacagcatcctacggctcattgtgatcccccggggcttctggcctatagccggacaacatgttcatcttggtacgtatgcgcgctggacgcagagctaccccaccaatcaaatccccgtcgccttatgatgaccgccgtggctcatattcatcctgcgtatcctggtgtagaccaaaatcgccgatctggttcaaattaaagcagccgacttctccaagcccagcatagaggctattgaggacaatatcaacgccaaatacgcaaataaggtaaactcttgccttcttggatagcattttaaccttcaagctcaccatcgtcttacaggtgcttcaaaaaattggactatgtgtctctctttatgacattctctggacctcagagggcctgatcggccacggcacaggcgaggtcaacgttaatggtaacagacataacaatccggatattttttccttctacaagattaatcaattattgctaacacttctcccgactatcagtggagtttcgtatgattgtcttccgtccttttaagggagaggttatgttaggcaagatcaaaagctcaacgccttcgggtatcaacctatttacaatcttcttcaatgacatcttcatccccttcgaggaattgcctgctggctccgagtagtacgcaccccaaccccccaaccccgcaaccgtgaggaataacactgaccccccgtgcagcagccatagcgaccaactctgggtgtggaagatggacgacgtgaggctgtactacgataccaacgaaatggtacgtttccagatcatcgacgaggagtggcacgaccagacaccttcaggacccagccaagctggcggcccagacgaggaggaaaacgcaatagcgccctacaaaatcaaaggaagcatggcgcgggaaggacttggcgtctgtctctggtgggacaactaatgaaccgagataaatggatcggaacgatatattcgacgcagcttttgatactctatgtccttagaaagagaatttagaacaaataatcaacctacgccttgataccctcaagaaatcggtccgtaacgtcatccagcacagagtagtggtcgacgacggcaaggttctcagcctcggccttgaactgcttgtcggggtcctggccaggtccgcccatggggttgggcatctgctgagcttgcatttgctgcgcaacttggctagcggctggatttattgcatgtcagtattacagcctaaacagcattagggggatgaagacgtaccgttgtcgcttccaagcagaaacacatagacaaactgcaaaccgaaaatgcagaggaagtaccaactgatgctggacatccaccgggggtccatgtccttggtctgcacaccagcctgcaacatgctcttgaacttgatggtgagagggaagggcaatttcactattttcaggcgttagtaggttatctagcttaaggacaattcttagtgggcgacgtactgataacatagccgctgaagaaggcgttgatccagctcatgatcaaggtgttggggatgatcatggccatgttgttcttcatcatgcccatcatgccgtccatctgggaggggtcggacagagggttggcgggaggctggcccttcctgtcgggctccttcagatatgcgccggactcgtagttggcggtcagggtctcgcgtcgagcttcaaaggacttcttggtgagggagtggtagttggtgcggagagcgatgccgcgggccagcgagcgctgttcacgcatggtctttgcgtcgatcttcttggccgcgggggcaagcatcacggaggcatagtgtcggaggacaccggtgagcaccatcacaatggtaatcgggaagagaatccagtagctgttgggcgggccatggttagctgtgttcacttgggagggggagctcaaggcagcggggagcacctacaacaactggggatctcggacgatcacctgatcgggaacttgcgccatggtgtcggttgcggagaagaagccttggtcgcgatcgaacagcgaattgatggaattgaggtgccagatgggaaatgatgacggtcgagttctgtctccaattgagctgtggtcggaggctggtttccgccggcgccgaaggaacagccaaaatgacagcttgctttcccacttgggtgagcgccccactcggtcccttcaacaccacgtatcgattatcgcattagacagcaaaccaacttcgagatcctcacgataccccagcttgttccttcttctttctttctttctgttacctatttatctttcgcaatctactagtcgagatctctctcgcatacccgcccacaatggctgacaaaatcaccctctacaacctcccaggtacgcacaccaccacctacaagtcgcgttcaagctcctccagcctactaaagctaacaatccctctgttccacagatctcaaaaacgccgccgacgatgccattgcgaactacctcaattccatcaaattcaagcagtcacactccatgatcgacgtccgcctggccctcggctactcgtccttcctcctcgccgccgcatgcgccctctgggactaccagttcggctgggaggcgaccaagctctacacggccgtcgccgtcgccatatacaccgtcctcagcggcgccctcaccctgtggacgtggaaggtcgagcagggcacaatctaccaagggaaagccccttcaggcgatgatgtacgtctctctaagtaaacccagcttcgaaccctgaaactaacctgttcccaaaatatacagctcttcattgccagcgagacgaagaagatggagcccgtgtaccggctcaagatcgcgatccaggacaagtccaccggcaagatcaaggcgttcaagatctccaagcccttcagcgagttcttcgatgagaccggcctgttcgtccccaagcccttccaggagttcctcgccaccaacatctccgtcgtcggcaaggccgactccaagcgcatccaggccgcatccgaaaagcttctgagcgagaacccagagctgctgagcgcggtcctcaacgccggctcagaaaaggaagccgagggtacagggactgagaagaaggccggtgggaagaggagaaaggcataaaaaggtgtgattttgatttatttggtagcggacaaattcgggtttaaaatgtataagagtacgctgcacttgggagcggaaaatagggtttcaatacagccgtcagtttttgtttcacgagtaacatttccgactctgtcaatgatgaatattcaaaaggtttgcaagagacgatgctattaggatgtgtattcttactagacatatccaacccgaccgatgctccatcctctatgtaatgcactagaatcaagccccctcccccatacaccagcttgtttatacacatatgtacccgggttaagtatatgcccagctctattttagatccgaccacgctgctctcgccaccctcgctagctttcgtaactctcgcacggggtttccacaggccagtgccagctcccgctcgacctggggctggtgggggaggagatgtcgcgaatcgaacagccgcggcagtccgaccatgatctccatggcgatcttgccagtctcggcatcgcgctcgtgcgaggtcttcttaagagaaatctcgccgacgcagatgtcgatgatgctacgggcgtgagactcacccttatcgggggactcgacgacgatgttcttcagcacctccagagcagccctggtgtcagtgacgccggctgcgtcgctctgcgcagtcgagatggcgatccgcatgaccttctcggagtcctcctcgtagatggggaagttcatgtgcttgatgagagagaggacgccgacgttgatgctcgccttgctgttggggggggcatccgcggcgggtggcgctagcgcagcctccagtaagggtttgaccagctggaaatagatcttctgcatccacaggggcttcacgactgcgaagttctcctttgcgaggatcgcctggggcgcgacgaccagctctaggtgctggctcagctgcttgccagtggcgccggctgtggggacttcgctgagcagtttgaggagtggctggatttgctttccgcagaaccgacggaggactccggcggcgatggcgaaaagggacagggatttcgtgcagattgagctgttgttctcgttgacagcagtttgggcctgctgtaaaacagtctctgcttgtcggttcaactgtgttatcaaaggctcaaccgtctcgattttgtgtttgttagagaggatagtcaagatagacctgaatactgctctggaaacagagtctgcagcatcagaagagatggtcacaccgcgcagcagcacgtgctgagcaattccagattcgaactagagaatttggtcagtaagtcaagtacggaaaggagtagatacccccgacttaccaaatgggacacggatgagggatgaagggcatctaacactccaagagacaaggtgttcggccttccaacgatgagccaatcccaggaagaggattgctcgtcaatggcaccgttggtggcggagatggcatcatcatggaaaagattaagggcgaattcgtgtgccttgagactgagctgctgctcctcactggtttcatgtaagacgaacccagccagagcagatatgaagtgcaagtattggtgttccaaagcgccctcggatccgttaaacttgtcacccagctgcagcgtcttgacgccagcaacctctgtgatctttgttgccttttgatacagttgacgaacgatgtagagggtagcgaggaggaaatcagcgtaggcctcagatacagacaaggatccggatacattgaatccatccaacacggcgtttcgatcgagtaggtcgagtccaggatacttggacacaatcgccgaggcccaggaaggatcccaggaggcgccgctgcgttctggcttcaactcctggaaggcttcgttgaaatagcgggcggcagattggatacttgcgaccaatgaaccccagacggggaaactcccgttagagcttgagacaatatccacttgcagagatttcacgagcgtcagataatttcgcagaccttctgccggcttctggggcagctttgaacagcctacgtaggcgagaagagagccaaagacatgagcagatgaagccttatcctgctcaccgggcgatgcggtaacaatctcaaatgccttctcaactagtgttgggaaggctttgggattcgccgtgacagctctctgcagcgcggttgtggtagaattgacaagctcgtccaagtctttcgaacgggaagcttgtccggaggcactgtttccgtacgtaatgatggaaaataaggagtcgcaaatctgagagcacgtattttccggtagcaacttttcgttctcgtcggtggctgtcaccgtcccatcagaggtggcgatagacccagatgagcgctgacaagccagtgctccagctccttggacagcctcagtggcaagcctgatttcatcctcggtagctccctccttggctcccaactggactgggtttctaaaaacgtcgtcgtaaagcgtcttgaagatgctgtcgatggcgctgaaatcactcctttcagaagtcgtcatcttagcgtcgacgaggaagatgcgtgtctcgaggatcacttgcaggagcttgagcaagtctcggctgtgagcgggcgcctttgggtgtcgcaggttttccttgatatgggtaacagctggggcagccatgaggacgaacgcagcgggacctgcgctcaatacactgaccaggagacgaccagctggcgccgtgtagagagtgctcgaaagatcgttgacacagtcacgcgtgactgtcagggcgtagtcgcggaggtcttcaccttcgagtcgcacagcgatggccttgaggacctcgagggttgcccatattgagtcctccacctcaccatttctcacttcatacttcaagctgccccaaatttggttaaagtaaggggtgacggagtcgtgtgggttctggtactcctcgatacaggcctggattgttttaaggacatcaagctaggttactgattagcacaggttcaacaagacatatccaattatacaaaccttgacatttgcggtgacaccgtctccctggtccaacttccccaacaggaaggggaaggtatgcggtgccaggtccttgttcgaggagaaacacgctcttagcgacagcttgagctgctcaggggtgattccagtaggcgaggttctcggcagactgatggggaagtatgccttaaaggtattatagacctcctccaagatctccttcgacggggagtactcgcggaggaagtatgtcagtatctcaaaccaaaccatcaagtttgccgggtctctctcattctgacacagacgtatcaggtcggacatgaagctggccgaggatccatggcgcgactgcagagccttggaagtctcgggcgaggtgacgagaaacttcagcagctcaaagactgccagtcgggtctttgcgacctggcgggggaagtcgtcctttagggtgcacactttttggatgatgtcgttggcacttgtagggtggaaggacttcatggcagagattctagaaagtgcggttgcggatgccaggatgcccgccttatgatcaatgtcgaacatggctccgaagaagcttaccagcagcttgactatctcgacgtttagttaccccatttcatacatcaagcaaggtcgtctggaaggtgaaaattcgtactttgacttggtttcaggacatctgttccgagatagtccagtgttcgtgacaggaactccaatgctacaacaggtcagcaatgcactcatgagaagcctttatctaggcatgcgccatcaatcacctttggctctagctgtccagtctggtgagtcgccatcagccatctcatcatccccttgactcccaggcatccatggctgaaccgcctcgacccatctggcgactgggttggtggggactgcagcactctgcagttctgccgtcaatgtgtcagtacaagggcagagtagttcccgcagtctgagatcttacccgaggcagcctgtttggcaagagatgtgagcttggcttcgtcatcagccaggacatattcaagggcgagctgccgaaaatcggccatggcgaatgccgcggggctctgaagcctggtcctgaccctggtcggtcttgatcctcacgcgagggagctgccgtgaagtattggatgagaagatcgagagtctaaagaattgatccaacctactcggaatatcacaatagcctcgtgtttggagaaatgtagaagcatgtgaagcacaccaccagaatttggcgggcaaatctgaggcggggcatttttagtgatctgccagtggaatagctccgattacatacaatttaagatggaggtcgagcctcctctgcttgaagctgtttcaaaaattgatctatcacaggtattaactagggaatgcagaattacatagaaataaattgcaattatattagtccacctcagtattcatgcagactgacctatttttcctcagacaacccacgtcataatgcgatattcacagtctagggtaggtgattccctatcgagggtcccacaattgataatgatctcccgctccgcgaacaattatccatcttctacatgcttcgacaacgagacacttcctcgtcattgccgccgtcctcgccatgtcttccctccggacccaagccctacggcacatcagccggtacgccgtgcgctccacaagaacattcaaccagcgccgatgggcccaagtccacgatgttcgattcttagcttcgacctggcgagcgcagtcgacgatcgacaaataccgagagaagctcgaccaaaaggccaagaacgagggcttctcgagcatcgacgagctgaagacggcatacagcaagaaaattggcgagatacaccgcaaggacgccgtggaattccccgaagcccaggtcctccagtccgccggcgcccaaaccagcactcccgctcccgctgctgccgtgcccaagactgaggccaaaccacgccaacaaccaccccctcccgcctctgggtcacccgagaagaaggcagtcaagggcctagacgacatcatcgacctcgaaaagtcccgcgccctccccgagaaggagctcacggccatctggcgcctccgccacgccggctcccccaacaacgtctgcgccgtcatccccgcggccacgtacagggccatggaggacgcggccagggcggcgccgcagttcgtcctccccgtgccgcacgagggccagggcgccgagatccacttcctgcagtggacgttcgacgccgcgtcgaggacgagcaccgtgctcttcacccagctggccgagttcaagaaccgcggggagttcgcgcagccgcacaccaccgtgacgcaccacctcgacctggcggacgagaaggggctcgtgctgatgcagggacagctgatggaggacaggggcgtgacgcccgagcaggtcaagtggctcgtcatgtgcctgcagcggttctacggcgggtgggagggcgattcggccgagctgaccggggagaggaggctgcgggccgatgagaggaagaggctgctggactggttcgcctcgggggatgagaggtttaccgtggagaagctcctcgacgaggccgagcgaataggttgaaacggaggggtgcgtttgttgaaaagaattatgaagaaatgtactataaacggtgtgtataaagtataaaccatgctctgatgtaggataaagtcagatgcggcgcagtgagtttctgggtatatacaaaataggctgtctcatgaacaagctttgaacgagtcccccgcccctgaaaactcccttggccttgaaatctatgtgatgccgtgtctactttatagctttgcctttggccccgcggcctccttcgcctccttcttcgcctggtccttgagcagtctccttaagatcttcccagagggcgacttgggaatgacgtctacaaacctcacaccacctcgcagcttcttgggcggtgccacttcaccggcgagccagtccgaaatctgcttcgccagatcctcgttggcttcaacgcccgcggtgggaacgatatatgctcgggggacctcggtgtgcaatgcgtcgtcccacacaccgatgactgctacgtcggcgacgttctcgttccctaggagcttgtcttctagctctgcaggtgcgacctgaaaaccctctacgaatcggttgttagacacagataggcgcactttgaaggggcattgctatacgtactatacttgatgagctccttgatacggtcggtgatgaagaagttgccatgctcgtcaacatacgcaacgtcgccggtcttgaaccacccgtcggacgtgaaggtgtcggcttggaggtcaggccggttccagtagccggcgaacacattggggcccttgacgagcaactctccatgctattcacgtaacatcagcataccgttctcacttcatagcgcagatgggggagggttcggaagaaacatacctcaccattgggcaggtcattcccatcaggatcaacgatcctagccaccatattcggcagcagcttgcccacgctcccctggaacctggaccactcgtccgcgaactgcgtcatgatggtcgggctcgtctccgagaggccgtacccttgcttcacgccaaccttgaggcggttccagacggcctcggccagctccggacccaggggcgcggcgcccgagttgatccacttgatggtcgacaggtcgtactttgcgacggcgggctgcttgccgagggcgaggatgatgggcggcgcgacgtaggcgacggtgatgcggtgggactggatgaggctgcaggccttctcgaggtcccagcggggcatgatgacgcactttgcgcccgcgacgaaggctacgttgagcacgaccgagaggccctggaggaacctgggttagtttccggaagagcggttgtgggttggttaggcatggtcttacatagatgtggaagaagggtaggacgccgagctgggcgtccacgtcccagttcagggacctggtgtcgatcttgtatgactgcatggcgtttgcgaccagattgcggtgggtgagcgagacacccttgggcaggccggtggtgcccttcgcaactagtcagcttcactttcgcatccgctctgcattgaaattgaacttacagagctatacaccaggtacgccgtatcaacagcaggatcaacctgcggcttccggggcttcaaccaagccccctcggccgtcacctccgtccagtgcttgaactcgcccttgtcgtccctcgcgtcgcccatgagcaggaccctctggcgcgggatccccgcagccttggcggcctcgagcgcggcctcgaggaagggccgctgggtgatgagggcctttgcgcccgagtctttgagctggtgggcgagctcgtcgaccgtgtaggtcgggttggccggggaggcgatgccggcggcccagtgcaggccgaggttgacgacgggggtgtcgacgcagttgggggtgtagaagccgaggacgtcgcccttgcgccagtcgagggagtggacgaggccctggccgaaggcgatggagaggcgctttatctcggcgaaggtgtaggagcggccggtgtcgccgtccacgaggagggctgggttgtgaaagcgtcagccgtgagaggttctttcttgaattgggaggggggttatcacctactgtggtcatctgtatagtctctttccccctctaggtacagagtccagaggtcgacgttgggaatgtcgatgtctgcaaattgggacgtgatcgccatggcgcggagatacggtgggcaatcacctggctgtgtgttggtctctgctatgcgaaggggagactttaaatatacggggaagctgcctcggtcaatcgcacggtagatgggaccagggagaagtagagaagaggaagaaagagggaagacaggtcggagacagcgagatgaagccgatcacgacaaattggggctcgattgggagcaagctggggtagctctcactaaaacctggactcgattccgagagcggcatggcgcctgcaagcccgatgccacccaggccgagattggctgtagccagcacaagccgcggtgtgtttcggttacggagtatgagacggagttcggggaatcgctggatgacgcagcgaagtctctcctattggccagtggcctgggagatagggattcgtgctgtgggacgttggggctgaccccgcaccaactccgcttgggggcatctgggcgctgtaaatggcccaaagccggggagcctagaggacccaaaacgtggggaaatcctcggcttggggattgggttccactaatatacgctgccaccacgacggttatctgtattagatcgctctcttttatctaggtagattctgtatgcgatgaattcccaggtttgctattttaattcttaatcccatgcggatttgttctactattgatatcataatgtctttaacgattgacgtattcaactatgtacactctatagctgtatgtatgtaaactcctcgctaatctcttgcatgcgtaaattcgtcatgtatatcctgttcaccagtttgtcattatatacccctagatatcaaacagaacggaagaaaatatagaaatccaccacgtgtatcaccagtcggctctcatacgccgtatctctccatctgctagagttcctcgcatcccgtcggcacccggcatatatctcgatactcgcacgtcttccacagcacctccctgacctccttgaacacctggtcaggcgcgtccatcgcccagatgacatctagatgctcgtactcggggatgatcttgctatgcacgacctcgacaaacggctcccggcccctctcaaaccgccgcagcaaccgccgcccgtccaccaggtcatcctgcccacacacccagaacgcaaacggcggcgcctggtcgtcgtaccacgcacccgtccccgaggacgaccgctcagggctctgcgacggagacgaccccgcaggcgacggcgccgacctgcgaccgccgggcgtgtcattatcggacgacgacgacctgtcgtactcctcgtccatgcggtcctcctcacgaacatcctccttggtcgcgaggatgcacttgtgctgggcgaagcactccctccccagccaccacctcatcgactcggcgctgacgtacacgggcgcgaactggaacatgcggtccctgagcccgcggtcccaccgctcgtccgtccagtcgaacaggaacgagaagaccttgtacccgagccacccgtacagccgcgggtccagcacggcgtgcatgcgcatcatgaaggggatgaaggcgtggatgccgaacatgagcctgaacagcgcgggggagatgacccgcatgaacttgaagtacatcttgccgatgagcgggcccgcgtacacggcgggggcgagcgcgcagaagacggtcagcctcctccccagctcgggccgctgctccttggcgagcgcgacaaaggcctgcgtcgtgccctgggagtggcagacgagcccgagcttggcgaagcccgtctcagagagaacgcgggaggcgagggccgggaggtcgaagacgcccatctggcggatgttccagcaccacatgcgcgggtcggcgtagcggaggaggacgtggcgcggggtgaagccgcagcggttgttgccgagccagacgtcgtagcccgacttgcagagccagaaggcgagggaggcgtcgtcgttgcagcagtaggcccccgcgctctggaggaggccgtgcatgaggaggacggggaaccggggccggtgggaggggtcccggaggcgggtgcgggaggagctctggaagacgtccgggccgcggtgggcgcgctcggcgggcgtgagcggggtgtactcgctcgggtcgtagacgtgccagaggtcgatgatgaagccgtcctcggtctggacctggcaggcctcgacgtcgaggccgacgcggcgggcgtagtagcccacgtcgcacttgatggggtctgggcccccctcggtgggcgggtattcgtcaggggggaagtcggctttgctttctttcgcgctggaagagtgcatcttcttccaggcctgggctttttccttcctgaccctttctctgcgaatctcctcggcgtagaaggggcgctccttgtccaggtcccggaaggtcagcttgtagaagatcttcttgcacaggagcggtatgctggtgaatagtgacccaaggacaatgacacccagaaaggccaggctcaggaaaaacgaggagaaccgaaagaaggcgcattgtaggtcacgtagaaaggatggcggcccgtacagcggtagcggagggaacagcgggttcgtgtgtgatggcggcctggcgctctgtagcgtgccatcaatttcattctcctctttctgaagtttgtcgcccttctggttcttgggtagctcgatgacatgctgctgttcctgcgactggtcattttttctggatgtgttggttacggtcttgccgtcggcagcctccttgatctctatggtccctggctggccctccagctcatctcgcagggagttcaacttgtgcgcttcctcgagaggcacaccggggaggcgatttccatcagaagtgataatgacagggtcgtgaggggtgacgaagtgcgcctgggtagcgacggcggatggatgctgcaggtgagactctgctgggctggcgggtgtctcatttgtctgctgcggctgctctagagagagcttctgggcctggagagagaatttgacagcactctcggccaggctggtggccgatgaggtcttgcgatggtctgaatgctccctgtgctctccttgttgtgattgtggttgttcttgtcgattgactttggcgtcgtctgttgaggcgcccatcgcaaacctcctttatgacgcaaccatttacaggtacaaaaatgatagaattatccagccaggggagacccgctataacgagcaacaatacacagatgctggaaggaagaaaggaattaaatatacgctgagcgcaacgccaattgacagaatgcacaaagatgcgagatatactatgtagtctcgagtcagagctgggacagaaatttcatcgaggacgttttcatctgggtgacatgtgaaaataccaccaaccaccgccccggaccagccaaaaagaagaccggcggcgatgatcagaccgctagttccatcgccggtcccccactcgaagcctcccctgatgacctggcgcctctcaatgaggcagcagcaggactgtcgaatgcatcctgtgcatgcgaagggccccgagtttgcccattttcgtacgattatttgggttgatgggtttttggttggaggtttgtcgggatgtgaaacagcagcatgagggccagccaatgcctctgcctgtactcaatccagctgtcgggcggaattggagtaaaacgcccagcgcagcagtcagagacaatacggtgagatctgggttgacctaccttaccgtgttcggcacttggtctggcttacgggccgtgttagttactattacctgcgaataggcagtaatactgtctataggtatcaccatcgggattctgcagtggatcccaccaaatccatctccaaccaacaaaccggccgggatgacgtgcatccgtagtgtaagggagctgaaagagaccagtaccagacctcattcgctcaagtagagatagatagacgatagtgggtggatggagagatggatgcatctggaggtattggtttggtgggcggccgatgcgccacctgaagcctcgattgtggtggctggtgggcagtcgtgatgtcatggcgtagtgacgaacagccgatccggaaatcaaccacaaagccaatggatgtgatctttgccctcctcttgcaccttgcctgttcctcattagtctccaggtcaagtctgccaaaggcaacggcgttggcaacagaatggcagtgcacttgaagagccttccaagactggctgacagcgggctagtagattacaggcacctcgtgttctaaaaatacaggagccccaccgccagcacaagcctctaccggggccttcagaaggcctttggccctctcccaggcctcacctaattctgcttccagcaggcccggcctcgatgctgaaaagcttgcatggatctcagtcatggtccgtcctcggctcgtccaacccaattcacccaagcgtatcgagagcttcaagggcctcgcgcaggatcgacggttcatcttaatctcgatttttcttttaatacatcccggtggtgggatacatcttggcatggtataaggcaaggcatcaaggcttcatcgctggttcaccaccatgtggcacggcaacgatcctccaagagccaacaaggcctaacttggaatgtgtcactggttgcagtaataagccacgctcccgtgccctccgaccatcttaaatggtccatgtggaacaaggtgatacccaattctgaatcagaattttgacatttggcccggtgtttcatgccatcagccctacaacagcaatgcgacgatcctacgctgtgactgagacgaacacctgccctgatgctctttgatggtcagaatgtctacgttgaattgggtttttggcctggtcgagttctagcattgatgctcatctccagtacctagaattaccaagcagcagattatgtccaaaatgggactatccgagggcatgttggctgacgatctcgtgaaccctgccactcctcagagtccgcaccctgtcgctgtacgagtagacacagagtgatcaaaatcttccatgttgtgtcttggatgagatgccatatcatgctgcagctgctaccacatgatccagccgactccgatgcaccaacaaagttgcatccatcgccacaaggctggcggcagtgtagcctttgtaggttcgcccagacaacaccaactttattatccttatttagccctgcttggccatacagggaggcttttccgagctaattagtccccgcctcacctagaaggccggtaagcacttgtcactgcgcagcacagaacatagccctgcaaatggggcatggaatcaagatggatcaatccccaggccccttttcccttgtccctctttgctgatcaagctcttctccaccttttaacacggtcctagtccggcttggtccgggcccgccgcctgcacatggtggtgatggtcgccgtattactccaagatgtgatagacacagtaatgatattcttatttcgtcctgccaagtctgggcccgcgtacccagcctggcgggattctatgttcttacatctttccgatcccctgacctcgttcctctagctgttcaattaaggtcgcctcccgcctttcttaatcgtctcatcttccttcttctcccttacctttctttcgcttcccttcgttcgcttcacgcttctagcctctacgtaatccagtcttttgtccagtcttgtgcttgtaccaagacacctcacactcaggacgaccgaccagagaggctacagcgtcgataattcactaataccttaatcctataacatctcataatacgaaacggaccatcccatccaccatgtctgacgaagttgcaaagtcactgggcgccacctgccccaaggggggatccttctacgtctgctacgacaagcccacccagttcgtcggctgctgctccgtcgacccgtgcaagacggcaacgggcgcctgccccgacgacaacctcaagtacacctccttcgacaagtactccttcaactcgctcaagccccagctctgcgtcagcgaggcgcccgaggtgcagtggtggacctgcgccgaggccaagccgaatcccttcatgggctgctgctccgtcaacccgtgcgagacggggtcgggttgcccggacggcaagatctttgccgccaagctgaacgacaagagggagcaggccgagcccttcctcaccgcggagcagcgtaatgctaacagcggcgggctgcccacgggtgccaaggtcgggattgctgtcggtgccgtgctcgggttcctcctcatcgccggtctggccttcttcttctggcgcaggcggaggcagcaaagtgcctcggccgcagggggatcctacgagcagtacggcgggagctaccccgagtccaagatgggcggctcgcacatgtcgtcgtacaccgcgacgtccacgccctccgtcgccacgcagatgccgtacgacccgtacgcgcagcagcaggcgaacggccagctatatcctcactacaaccaggcaatgcacacacagggcggcttcccaccgtcgtccgtgcacatccccaaccagccgacgccgcctcccatgtccggtcacccggtgccgcacggccaggggcaggctttcgccgccgagctgcattcggagagcgcctcggatgtgtatgaagggggcaagaagcccacgcctaccgaactaccctgagaaaaagggtaattcatgaaaaccagccgcaatcgccgaattaggaagattggcgtctgagatctgtcagatatcattgcatgaacttttcatttgtattgtcgttattttagagcggagtttggttcagatggattggtatatagggaaccattgggcatcactggagttgggtagagcgattgttatagcgattgacctttgcgtcgcttgatttatggtgaatataagccattctatgatacgaaacagcatttggtgccctaatttgatgtgaagttctgttactggctctaaggtaaagggtagcacatgctccttgggatctggtctcctcgaactcatggtttgccttggacaatccactttacttgctgcatagcccggtggcgttcttaagcgcagcaacgacgccggcgtaagcggggtggtgggagaaatcctcaaaccaaagaagcgctgcgccctcgccctcgaaggtgtacggtacccagctgaacgggtcgtagaaatcccaaagcgtgatgccgatgcaagcagggacctgagcacatgcgccgacagactggatgtcgagttagccgtcttggcacaatatagtcccatctgtgggggagactgtagacttacattcttgtagtcctccttctgcagcgccagcagctcatctgtgggaggaagcttgtccaatctcacgtccagctccgtcaaggcaacctcaacacccagcgcctcgtaagattgaatcacgtcaatctgctggtcgagactgggcgcctcgccggccgtgaagtgagcctgcatgcccaccccgtcaatcttgatcccctcatcctgcagcatcgtcacgagccgcagcacaccatccacctttgccccaggcttctcaatgttataatcgttgtagtacagcttcgcctcggggtccgcctcggcggcgagccggaacgcaagcttgatgtagtcctcgcccaggacgcggtagaagatcgactggcgccagctgccgtcctcctcgagggcctcgttgacgacgtcccatgcgtagcacctccccttccagtgggacgcaacattggtgacgtgcgcggtgatgatctcggtgagctcctcggccgtccattcctgggcttcgacccagggggccagctggctgtgccagactagggcgtggcagcgcaggatcttgttctgttcgcgcgcgaggctggagacgatctcgccctcggtccagttgaagacgccctgctcgggttctgagaagagccactggtatgttgtcagtaacctagattattccaattgagtttgccaattggggggtaggagaggctggagcttgagttaccttttgcccattggttggggtcgtttggccaaactcgttcgggttcgcaaggatggcatcgtactgggggtaggcgtgctccagaccagcacgctctcgctggccgggggaatcagtggccgagccaaagtatttgaggccagccttcagggcccattgatggagctgggccgaggcgggagcgaggagggcggcgagaacgagaggcctgaactgcatcttgggttattgcaacttcagatcgaggggcagaggcaagtatagagctcttttggaccagaacatagcttcgattgggaaaatggaagcaatttatacattcgacctgggctggcattcttgaaaatagccgggtaaagtggctaatagcacagctcgagaggcgacttgcctgcatcgtagagtcctgccacagggccgaagatcccaggatggcggctaaaaaggaacgtcttatttgggcatggcggagagatgtggagtatgagcttgtcgcaacgtacgtcgagatgttggatggactgggcgaagtccatcaacggccctaggtgaatgggtgttgggttgaaggagaagtcgctggagccgatgacaactgcatttgacttggagctggaggcggttttctgcaagagttgggttgtaatacaacctcagccgccatgagtatcaaggtaagactctggccccagcaacaaaacgatctacagacctgcttcccgatctatggatgcataaccctgtatgtatacgcgccaatcggccatgatatcctgcgaggcaggctgggatttgtaggagcgcaaggttggagccagctgcatgattacagatgtgagacagatgatgggcagaaagaacctgctgcagcgtatgcacccctcagtacataggattggttgtcgccgacaggaagggcctcatctcggttcaagccatttgcgaattagccggtgtgtggacagtactttcaatgtgccgtgttcctcctcattattgagtagcaatggcgtacatagactggcccaagccagacagatacacgaatggtcgcagggtggaggagtggctggacgggggagaaggagctggaagaagtgcagcaagtcgtgcatgagtatgggtcacggtgagctgatgctgcatattatgtggtagcactggctccggttgcaacccatcaaactttgcacagacatggagatgaccgtgacacgaagagctgacgacaaatgagagcaggactgaggtggggggatggcatgaggccaacggcgatggtcgcagctcgggcagcgctgcttagtcaccgtagctgggtacctccaatcgcgagcgcgcctctgcttgagcgcggtacacggtacctgcggactgtctgcgggctgcgctttcccggggccagtgccactgcagctgctgccgcctgccaccttcaggcagctttgcttttgggcgaggcgaacaaaaggaacacctattctttctctccctttctcttcgccatcacatttagctctatctgcgaccaacactttcgctctcttcttcgctttccaatccacacatgtcaccggcgacacagttccacccacagccaagaccagccctgccccacgatctgcgctgagagtgccgggaggccggtgggaggggagacgacccggcaatggtacaactgaaccactaccacatggactgagcttgactctgtgctgccttgcagtcatttcgcctatcctccaactactttctcaatcattttgtgcccagaggagagcttcatagttgcgcaagacctccttggtctctgcgctggaccactctacaccttaaccactcccagcactgctggcctcccttctcgacaatggaccaaatccagcgccagcaccatgacatggctacgtatatccagtcgattcgccaatccatattcaagatagtcctatatgctaaggacaacctatctcgggacacatggatgcagcatcgcctccagatcgtgctatcttctcttgacgatgcgctaagccgactcgacgagagtctatctcgcgctcaccaacagggactggccaagactactcaccccagcggtgatagatgtagacttgaggttccctcccccattttgcagagctgcgaggctactgtcaactttctcgcagccgacctgggcaccgcacttgcaagcaacgatgcggctcccatgatcaagctggaatgggtctgcgctgccatttctttctgcataaacacggccacctcacctcaagatgtgctgctgcgcctgtcgttctttcgctcagaccccccgcttgatttccgaatccagactcaggaccttgtcgccaagcgcaactcacgaggctttgttgatttgaggcaaagacaaggcgatgcgcccgtatctgtagacgacgtttctctatggttgtccccattcctgagcctcaaatgttacgagccgggagaatattactacgaaagggtagtagccgagctcatggagaaaacatgtcagggactcccccatgccgccaccgaatggcctctccatgcggagcaattctggcccgctgtcgaggacaaggttctctcgttgtttggcccaagcacaatttccccaaattttgggttcataaattggattctgcatttcgcccgagaagtgtggcctggcgagtttggctggcatacaccttccaagcatcctatgattgacctgaccgacgctttgtgcagggggaaaattggtcccttacacattgctgcagctttcgcattgcccagcttatgcggtcgactaatttcctcgggtgccgatgtcaatgagataggcgccctcgggacgcccttgtggtgcgccttggttgggcccgatattctcgtcaaccgcatggccggcaaggcttggaacccctcctctggtcgtcactttgctagccacaaccgttcgcccgccatcaagagactcctggatgctggtgctgattgcagtaatgggagtgggttagaagacacgggagacgagagtctttcggtgtctggcatggcattctgggtttcgctgaagacccgagacgattcggttctgcaacgcatcattcagtccgggcctgttttcaaccaggccctaaccaaacttatcgaaaatctcaacctagatgaagaagaaccccatatgagagatcttgtatcgcgactattgaccattctctttgatcactgcgtcctcgccgagtcagaccctgataattggggcttgggtgcggctctcagcgaggccatgtctcgcctccaactgaacctcaaccccgtatcagccgatgggaaactaggtatctcggacgaagcacttaaccacctggccgttgccgctatcgtcggtgatgacgcgtggtctctccgccgctgtgtgttggatcctcggttccatccaggtctgccaaccaacaaatttcaacgccgcaacacacttctgcacatcgccgttgcggatgacttctttgaagctgtagacattctggccgaggcgggggccaatctgggggctttagacgaagatggtaaaactcctctcatggtcgtcgagagtgttgccatgatggcgaagcttgttctggaacatggcgctactactacagagtctgaccgtgacggtcggaccatttggcacctggccgcagcaaccaacgagcctgaacttctcgaatggttgtgtctttttgacccgtccaaagacatcaatatgaataaggagacacttgctgggcgtaccccgctcgttgaagcgttgctcagcaccgacttcctgtccgacaaacctttcaacaagactcacaccgagcctaaagccgccaaggtgctcctcgggcacttcgggaatagactgtcgcttcggtgtgtcggaagacctctcactcacctagtcgtaccttggggagataccaacttgcttcgcagtctgcgtgacctcggcgctgacttttctgagatggatgacaatggctggacgccgctccattggataaacatgtctgctactctagagttcaccgagctgctcattgagctctgcgatggtgtcccgcacatgtcatattccggcctcactgctgccgagaccatattccagaatacggttctgctgagctcgatagagtatggcggacctgagcgatcctcgcacccatcgtgcaggcgcgaactgtctatgagcgcgtacaccagactccttgaccccgaaatgctccggcagtgtgatgaccggggtaaaggcttctggccccgtttctgcaggaacgttttgacgaaaagcattgaggtgtctgagaaggagcatagaatggcccagccgtcaattgaagcagcgctacagtgtgttttgagcaagggcatcctggcagactacgaaaagaagactggccagccaggcatcatgtgtctggaagggttgggtacggaaaaagtagtcgacaaggccaagtctcaactcgaaactgaatcaatcgatagattttggaacttgaagcgccttcgtcgaatcatcatcaagatattgcgaaacacttccaattccatgaaacgattgttttggagcacggcagcatgccagaggttgctggttgagtgttgcgtggataaaaatttcccaatcttgaggcttgtctgctccaagggaggcgagcttgatatggacgagcgccgttactctggtctcacagttctcgaggcagggatgatgcattatgcagagggtcctcaggagcctctcaaatctctcctcgtaaacacgtctgtggatcagcttaatcgccaccaaatggttatcttgcgggctatttttaaggtacatcaaaaacaaaatgacattgacgtcgaggctctgcttcatttctttattgaacgaggtatgcgcgttaatcctgcacgagatgatggagagtcactgctggccgaagccttgagatgttcccagtaccatgtcgcgctcatgttggtccgtcgtggtgctaggctggagcctggtcgccacgggttcaacgccttgatggccgcagtagaggcagacgacttgagggctctctattttcttatcgattcgtttggccaactggggagagatgaagtgaattggggttcgctctacctgcgccctggtttgcccccgcgaaatgcgctgcacgtggcagcagagtgtgcgagccaggaattcctgagcgaggcgttcgagggcttccccctgctgaaggagcacatcaacttcatcacagaagagggtggaccaatccatgtggctatgaatcgggggaatgttgacgtggctgagatgctggtggaacatggagccgatttaacgctgcgtgataccaacgagttgcaaggctacactcctctgcatcttgcttgcaggcatactgaccgtgaactcctcctattgtgcataaacaaggcacccgagactctccggttcaaggataatcaaggcaaaacgccggtggccctggcgactgagctcggcaacgacgttgcactgtctttgtttaggacttatggtgggatataatgcatcgtttgatgcgacatcgatattgtgtttgacgatatgaaggtaatgacactcggaaacttaagttggattcacaacagggcaaaaggacaaagggataaaagggacaaatattgggctggatgggttggacaggtatttattgtacggtataaggcaaggtagatgctgggtttcggtagttgaaatgagattgacctgatgagagagatgacatcgccggctgaagtctgaagctccttcgtattttctgccagactaggatactagattttgattgctcattattgaacaactgtctcagaaacaccgcatgaaccaaagccgtaagggtttccatccgtatgaccgttcagctgcgtactgtgaggaaggtgtatccatctgtaacgcgatttacctgagctacacaaggcatattcaagttctaatctaaggattgccctgatatgcctcgtagcattagcgcagaggaaatccaagtcttctgtcggtcttacataatatgagcaactcttatagtgtctttgtcaattgagagtggatgctcctaagcagctgatgttgcaagttcatcgcagttatgctgttggtccgacacgttggtccagggatcagatcatgttgatatttttagagcatttaggctaggaaaaagcgacaaaaaatggcttggttctaacaagaacttatctaagccctcttctcaatgtcatattttggctaagagagacaggaaacggaacttggggttaggacttgggcaagtttggcaatatcatattggcccgtacatgcactctgccggattgtactgctgtccccaactgccaacgatattcgattcgtacacattttcacatgttcatctcacaagtcccatcggtcatgtacttccccccgtatctcagcactctcgccccggagatcctggagctcatcattgagcatacacacgcttcaggccactggcctcttgcgcagacgtgcaaatatatatacctcaactcactcccaatcctcgaccgccatcgcaaggcatgccaagagtatcgaatatgttctgatcttaattcctggaccatctccagactcttgtggagtgtcttcagtgatggcgccgcttccatcgaggcatggcacgtcagagagtttgaggtctgggtcgagagagaagaacacgaatcctggggagtgaatgccgatactggcgagaggattctacacgaggacgtgaagcccaggtcgctctctagccacgatattgactatttctgtactaagatgctgaagctgccgaatttttatggcgagcacggggatctcagtcaaggcgtccgggaagaccttgaagcaggccgagatggctttgtcaaagcccttgtcctggcttatctgccgcgcatccaggctctgcgctatgcccagtttgatgacgagcgcaggaatgcgagcctgctggccctgtgcggtttcatttaccggtgcaagtctgcagggacctggctgcctggattaaattcgttggaaagagttgccgtcgccatacgccttgaccgagccggagtcgaggtagaccccccgggatacttgaggagatatgccgatgagttctgcgccttgttgtgcttgccaaacctcgctgaaatttacttttctcatctgggtgggggacttccactggggtggaagtctcgtcgtttcccagaggaaatccaaatacccttgctggccaaaacatcgtccgtcaagacaatcattctcgacatgctggaatacgagctcagcgacaaactgatagactttgtgactagtactctgcgccgtcttgagaatctggctatccgtttccgcgacaacaactactgcgaagaggattatccagaaattgctgagaggttgatcgaccagcttgccaaacatcagggctcatctctccagcggctatgtatacatgatgaccggcaagacgacacaccggcagacatgaactggaggaccccaggccagctcaggtcgtttggggatatccgcgtggccaacgtgagctggaaggcaatagaggccagcctggaccttaccaaagacgacatccgatcccgatcccgatccgagcttcttggtcggcttttcgaggtgttccgacgcggtctgccagctacaatggaagtcataacattcggccagtttagatttgaaaacgatgaccctgttttcttacaggcgggttgggaggagactactgactctaatttcggatatgtggatgacgcggtcgaagcgatgatcacatcgaggcattacaagaacctcaaggctgtttttctgcaagacattcagaatcaggcatcttatttctacggttgcagtctctgctttcccaaaaccatgaaagcagcagagagtcaagggatccgtgtttatacaaggggaagtaaacccctccctggactcagcaccaatggcgagttcgtgccctttccaaggagggattgcatggcgacgggtcagtttgaggctgaaaagagagaacgtctctactgcaccaagaagcggcgtgagttttaggcaggctgaggctagtaaattcattgatagctagattttatatataataagttgaagtcagggacgtcttggattctccttcatcccagccgagtacgaggacccgtggtgcgctggctcttgtacgcctgctttgatctgctgttcaatcttctgcctaatcacgatcgtcgcaagaagctacccccgaatggaccagcaactcgctgtttgctccttactaccaccagctgtgctacctgctctgcaactctctcgccggacaaggcgaagcggactcacgcaaagtaacacatcccagccggggatgcttatctcggaacaaggcctcgtggcaactcccggccacaaccagaattgcagggatcgcggggcttatgtcatgcggtttcaacgttcaactacctagacgatccgcgtggctgaaaagtaattggacaggcatctctcttccttagtcgattgctaattgttaatcaccgcctgctattggccgtgccttttagtgctgacagcatcaatgagtgtggcttctttcttctctcattcaacacctctcgatactcccgacagctctgtctctacgaagccttcgacgagaatttgaccctctctacatcatccatcatggcgtggctgactctggcgtcgacgattggcgccgtgctggcaacgacagtcggatacattgtccaggcgactttccgccatcgccgcaagatctacaagctccggaagcaaggcattgcaagtcatgaacccaattacccgcatccatgcctgatgataaatcgtctactaacatctacccgtcttgtctgtaaagcccatgcccgaaggatggagttggatctttggccatcttctggtgctccaaaagtatgtcgacggcatcccgcccgacgctgcagtggcatttgcaatgagaaatctcagcaaggagtttgccgatacggaactcttcctgatggacgtctggcccgtctatcccgctctctacatgtgcttcggcccagaggccatccacgaaatctgtgtcaagtacaacctgcccaagacggagcaggcagacaagttcatgcaccctgtggccggcggtcccagtctcctctcgatgaacgggggccaatggaagtactggagatctttattcaacccaggctttagttccggggccatgctagacaatgttccccatattgttgactctgtgcatgtctttcgccagaagctgttcgacatggtcggcaagggtttcttctctctcgacgagttgaccacgcgactgacgatggaaattattcttaaagtctcgctgttcgtgtctctatcatctcttaacaatctgtcgaacacacgcttacattgcctgtaatacttagtgaccacgactccaactatcaacagtctgatcacgtactcgccacagcccttggccgcatcatcgcagtccattctttctggaaccccttcatcttgatgaaccctcttcggccaattattcaaaagtacaatgggcgaatcatggacaagtatatccgtggagagctcgacaaacgatttcaggaagcaaagctggagggaaccggaggctctacctccaataagtctgtcatcgctctcgctctgaaggcgtacttcaaggagaacgaggacatcgacatccagaagcaggataaaatcgatccggtctttgcgcaatacgccacctcgcaaatccgcgtcttcctcttcgccggcaacgacacaaccgcatcgatgatggtctatgtctaccatcgactatccaaacaccccaaatggctggccaagctgcgccaagaacacgatgaggttttcgggagcgcacccgcagacgccgcggatcgtataaaggagagcccgagtcttctgaataagtgcccgctgacactcgccgtcatcaaggagacaatgcgtctccacgcacctgcaggcacgatgcgctggggcgcaccgggcacattcatcacagatctccagggcaacttgcagcccatggacgacagcgtgggggccaacatcctccaccaggcgctgcacctgaaccctcgcgtgtggcctcgcgcagacgagttcctcccggagcggttcctcgtcgggcctgaggatcccctgtaccctgtcgacgcagcataccggccctttgaggcggggcctaggaattgtattggtcagactctggtctggaatgagctcaaggttgctgttatcctgacttgccgggaattggagatcagggatgcttatgccgacttcgatgcgaagagggagcgcgagatgggctggttcgccagggtgaggaggagactgtttggggggccgatacggacgctgcatggagatcgggcgtatcagagcgattctggaggtttgcatcctgtggacggatatccttgttatgttagtcgggtagaggcgagctgaagactcctacagcaatgtcttcttgatagtcttgatgaaattcccctaagtaagccatcggcgtacagctaatatgtcagtgggtatcagtatccaattcaccatctacttacacgggactaaaacattaccgaaggtctttcggaatgtatgtcgagtccgacacatcgagtcagcagcaggccaagttcaggatgcttcatgcccgcctgtttgcattggagccgcaggcctcggcatgaatccagcctgttccacacggcattgactgcgtcgaatcatgattcaacgtattgcggttctcaaggttgaggggtgaggggaaactcacatctgcggggttgctcaaggagggacggatttgcacagcgagtattaatacgcagttgatgctgccatcaaagataatcaatagaccatggctatgaccatcttgaatctagcctcgatcattcacacttcttctccataatcccccttaatcaactttctctcgctcaatagtatcaaaggcacgacgccaatcatggccagcttctccctcacagagccaaactcccgcgagctgtccggcggagatctcctcgctcagagcctcagccaagcaggagtagaggtagccttcggtctccacggaggccatctggacgcattcctcgtgggctgcgagctggccaagatccggctcgtcgacacgcgccacgagacagtcgccgtccaggccgccgaggcctatgccaagttcagcagcaagatcggcgtctgttttgtgaccgccaacagcgggtgagcagaatatccatctggctggtcttttcattctatccaatattagccagatgatgaccggaaagagcagcttcggaaacggtctcccgggattggcgactgcattagccgatcgctccccgatcctgtgcatcacctcgtctcctcccttgcgagacaacgagaccaattgcctccagggcatcatcgaccaggttgttgctgcaaagcctttgacgaagctcgctgtccgggtgacgaatgcggaggagaccccgaggttggtttctcatgccatccggacagctttgtctggcacaccaggtaatctttattgaacgcatcagatagatcaggctgatgatgaatcttggttgcaaggcccggttctgctcgatttcccaatcgatgttctcttctctcctgtccacaagccgctcatctcctgggggtctatatcttcccccctcacgtatgggccgggagtcaacacagaggcagtgaaagaagcaaggaagattcttgaatcgtcatcccgcccagtcgttattgcaggatctggagcaacttctgttagtgtaagtacctattctctcaccttcatctttcataatgtagctacgagctaagcgcaacttcacaggccagaaatgagctagccaagttctccaaagcgtatcatgttcctgtattcgatacgcttaaatacagtgtatcgaccatccctacagactcctcattttccggtggatcagccgacaagctcgcctatctccaaatactaggcaagaaacgccccgatctcgtcctccttctcggggccagaaccggaatgttcctcggagggagggccggagggatcatacccccagactgcaagctcattcacgtggatgtagatggtggagaaatcggccgcgtgctaccagtagctctgggagccgtcagtgactgcggccaattcctcgctgccatgaactccatcaaccaggaaagcacatctccaagccatgtcgacgaggaatgggtcaaagatgtcctttccctgcggcacctaccctctccctttgaagaagctccgacgctccagccctccaaccgtcttcacccgtatcacgccttgaagagtgtcttttccagcgtcgagcccggatccatcgtcatcctggacggcggcgaggccgggctctggggcgcggacacactggccgcatgttctcccagcgcagtcgtaaagtcgaccgggaatctcgggttcctcggcaacggcttcgggcacgccctgggcgcggccatcgcaagccccgaccgcaaggtggtcagcatccagggggacgggtccgcgggattccacctcatggagctggacacgtacaagcggcacggcctgaacatcctgacggtcgtggtgaacaactacgcctgggggatgagcctgaacggccaggacatggtgtacggcggggatgagcccgcgcggccgatctcgtcgctgagcgagggggccgagtacgaccaagttgcgagggcactggggaatggcagcgcgaggctggagaggattgaggatattcccgaggtgattcggcgacttcaggggcagactgggccgagtgctgtgaatctgatcgtggataggtcgccgactcacccggggacggaggcgatggttggcgatacgaaggaccccaagaagattgtggttccttattatgacaacttgccgaagattacgtacagtgagtagtttggcaaagggcgaatccgggttcgagatcaggggtagttatcttgaagtagtggtctggattcattgcctcgaacgaaatcgagcaggccaccatctgaatctggggcaggatacaaggcgtttatatcatctcatttactgtactgcacttttttattctatctatatccatcactttaatctcgccaagggatggcctcccaagctatggaatatcaatgaatatctactcattacatggacactcatcagcctgaacaaccataaatatattctttttatacaaagccatagtctattctgcccattacacaatttgatctgctatacgtcgcttgttgttactagtttcagtcaatttcttcttcccaatcttatactctacccttgccacctcatgccatgctcagtttcaaagtcaaggctcgcgtataccgtccaggaacatctgcttcatctacactcaggcaactgagttcgtcttcttgcccgccctgtactgccaaacagccaacaccgagaagaagaagccagcagccaccgccacagcacccccaaacacccagacgctcgtccaatgctggtcgtccggaccgcccagtatcgacccagcacccgggcctccagcaagcatcccaaacgcaatgacactgaaccccatcccgatccgcgtcccaatcaccgccttgtcctccgtcaaccgggcatagcagacgggcggcagcgcaatcagcacaccactaaagaacccccccaatacagccaacaccacgacgcccgcctcgtccttcacagccagcatgcagaacatgaccaccccgaagaccgccgtcccgggagcgatggtattgaacggccccaaccagtccgacagcgccgagggcagcacgcgtcccaggcacgagccggcgttgaacacggccacgaggtagaaggacatgtccctccccgtcagcccacgcgactcggcgaagaaggacaggtagaactggatgacgctgaaccccatgaaggcgaggaggcacgacagcgtgaagaggatatactttgtgtctttgagcgccgtcaggtcgatgaatgcgcgcgggcgggcgggctttacgcgggtgcgcatgacggcgcacgggaggaggagggtacccaaggcgatgaaggcgacgacgcggacgctccagccgaagccgagggtgtcgagcagcctgtacatgacgatgggatatataataccgccgagggaggagcccacgagggctaagcccatggccaggccgagtctcctgctgaagtaggtcgggaggagggagagggtcggggtgaagaggcagccggcgccgaggccgacgcagacgccctgggagaggacgacctgccagtactccttactaatactgagcatcatgtgcccgaagacgatggcgaagctgcccgtgaggaggagggcgcggaagtagcccctgtcgtgcacgggaccggagacgatgcccgtggccatgacgatgaaggcctggacggagccgatccaggagatggccgaggaggaggcgtggatgaaggcgccggactcgtagtaggtctgaaagacgccgaaggtgttcatgatgccccaggtgttgaagaagatcatgaagcctcccacgacgtggagccatgccgccaggccgccgtctgggggaggtgatggcgcggcgggaggagcatctctgacgaggggcgggcccatgtttgggttctcggagtcggagacgttcttttcaaaggtctgggtgttgttgtttccgttgattgtttgctcgtcgctgctctccatgttgtcgcggtccagctgccggatggccgaggaagacatgccggtattcgggaccaactcgacactcatcttaacgagaagatcaaacgcaagaaacagatataaatataccaagtgaagacattgtgatccaatgccatagccacgatatatatagccatcacagcagcaaagtggaatgtccgtccacgaacctagatagaagtccaaccaccagcaacagttcggaaatccgacactcagagatcccggcactcgatcccaatagcccgggcccaggccccatctttcgtatttgcgagactggttccctgccgagatctgagattatcgttaagtctcatctccggccgatctgccccaccgaactgccgttggatcatgagtcatggccggacttccgacaggcagaagcgtagtagcaaaacaccgaggcatcgcaccactagaatcaccgtccgcaacatggtcacagcatgggaaactacggcctctcgcaaggttaaagcgcttagtctcccattatgtccatgttttctccatgaaattcccgaaaatctccgattgctcgctccactcattcggccaaggagaaagcagatgaggtgaagagagcacatgtgaatcatgaaggcgtggagagagcacggagatgttacggagacattcatttggggctgagaagaggctttcactttattgcaacatcggatcatgcggggaattgttttgacaggaaaagaatagaattgtccaaagaggaatactaactaagaatactagctaatcattcagtgagatcaaattgtcccctctgctgtaaaaacctgccaaaaaaagaaagcaactggccactaggaccatccctgtcctccggcacacaccaccaccatccactatgtctgtcaaggtagtatgtacaacttctccgaggctagcatatttgcaattagacctcagcagtggcggtgagaactgggtatctgtccacaccccagccgaaagcccgcttgagagccttccaggactcgatcaagacgaggtacaaaacgacggcaccagcgacaacgccccactcccaagtgagaccgaggtgtttgaagacccgagtgttcaggtatgggatgtagacgacagggaatgtggccaggaagccacagaccacggaccaaaacaggaacttgttgtggtagacagtcttgaagaccgaaagaggaccgggccagcgagggtccatgttgaagagactgcggtggaagtgcttgacttcccaagacgtgacaaggaggaggaagctcagggtcgagaaggtggcagcacgagcgcggtagacgccgtcacacccgttatcaccagactcgttgcagccgtggggaagatcgtggaagccattgccggaagaagcgtaagccgtgagcatgaaagtcatcaagcacatagcacccatgcaggtaccatagaccatttggtcgcggaccagatccttggtaaaaacgccagtgcggaggctgcggggaggacgcttgaggatatctggctgagcttcttctagaccaagaccgagagccaaaggagaagatgtgatgaggttggcccagagaatttccaggggagacaaggggaaaaccgaattgtttgatgtgtccttgaacgcaagaccaatcagaaggagaacaacctgggccaagttggaggtcaacaagtgcagaaggaactaaaaaaatattagcaagttgtcttgagatgcacggcggagaatttcggacttaccttctggatgttgtcggacaatctgcgaccctccttgataccagtgacaatggaggcaaagttgtcgtccgtgaggaccatgtcggaagcctctttagcgacatcggatcctcggtcgcccattgcaataccaacatcggcctgcttcagggcaggcgagtcgttgacaccatcaccagtcatgatgcaaaaggcattgcgacggtggagtgcttttatcatgcgaaccttggtcaacggactgcatcgggcgaggacgacggggagactctcaagagcatcaatctgctcatcggacatgtttccaaaatccgctgcggccatcacggcgtttggtgggaggaccgcagatttgtccaagatgccaacctcgtaggcgatcgaggtggccgtcttgatgtggtcaccagtgaccatgtgcacggtaataccggcctgtcggcactggatgacagcacccgcagtttcctgtcggggcggatcgtagagtccggcgagaccgaggaattcgaggtcacactcgaccttggagcgttcgttgacctcttcggaatcgtccatggacttggtggcaatgcacaaaactcgaagaccctgtccggcgagttcatcggctttggcaaggatatcgttcttaaattcctcgctttcgttgaggatcttcatcatgacttcaacagcacccttggtgtaaaccttgcgagttttctcgatccggctgccatagacaacgctcatcaacttgcatgaggagtcgaaggggtgttcggcgatcagctcatcggagccagcggcctggccgaatcgcatcgcgaacaccttgagcgcaatttccgtaggctcgccagttgctttccactgagcggtaccatccgcagcagtggtgacgctagaggagtccgtttccggctccttgcggccgtccgagacgacagcattgttgcaaaggaccaggcagttgaggaagcggctgaggcagcttccagccagaggggctgaccatgtaacctgtccactgcttgggtcgtaggggtccgctgttccttcgacagatccctccaagtttcctcggagccagacctttcgggtgatcatgcgaccctgggtgagagtaccagtcttgtcggagcagatgttggtgacaccgccgacggcttcgagcgaaggcatctggcggacgatgacattgcccctgaccattgccttggtggcgacggccatggtgacagtcaagactgcgagcagtgactcggggataaccgcgacaccgacgcagataccgtacaagaggacttcattgctcacatgccagagactagcagagaatacgataatggcgagcaggatggcgaaggcgaatagcaaaagggcaaacttgctaagggtaacctggagcggtgtgccctcgagtccaagaataccacgggtcgtctggtaggctttaaggaagaacttctgggcggcagttttgccttccatgtcgttcttcgacttacgaagaagctcggcaatctggccgacttcagtcttcataccagtggaaataacgagtccagttcctcgaccacgtgtcacagagctaccggagtagcaaaggttggtgcgatcaccaatgggcatgtcggcgtcggtaaagacggcctcgggtttcttggagatggcaatggattcaccagtgagaagggcttcgtcagtggccaggttgataccctggatcagacgcaaatcggcagggatgacatctccagtagcgagaacgacgagatcacccttgacgagcgtctcggcctttactgtttcattgacaccatcgcgaataaccttgcacttgggggtggaaagggcatacagggactggatcgtttgctcggcacggtaatcctggatcagtctgaggcatgttagcacgaaatacagcataatctttggtagaatcgaggggtaggggggagcacgtgagcaaccgaaatcaagacttacccgacaacaatgttgaggacaatcacagcgcatacgacgccaccctcgacgtagtcgttaatggcaaaggaaaggactgccacggcgataaggacaacggtgagggcgttggcgacttgggccaggaagatctcccagagggagagtcccttggcacctttgatggagtttgggccgtcccgggcaaggcgggcggcagcctcttcactgcttaacccatggtcgatgtggctggagagactctcagcaacacgctgggcggaaagcgtatgagggcagattggcttctctatggctaattctggtagacccgctataggaggctggtcgtccggattgccgacggtcgacgagtccgaagaggagctggcgtggtctgcaccattcgtactacgaacttcggtttctcccatcgaatgggtataggcgtcaaaggtaggcagcggggggagagcaagcgacggcttactcagtggcaggggagcgttgaaggtggtcacgcgacaggtctggttgggctcgtgcagaggcgacggacaagaagtcgatcgaaggaggatttaaccttaagaaaggcaagataggtaagagagaaagaaagaaagaaggaagagtcgttggacgcttgcgggagacagggctctttatccttgcgccacgacagacgagacgcatagctagtacatactacgatggcaatgtgggtgtgtgaatgctgttagtatgtgggatccggctcgagcaaggtgaatcgctgtgacacctcgtcttgggaagccgcaacccagacagcctcccagaagagatgcaacacccatgttctgcaagcaggccagagctacaggggggtggaggggagcattcggccaacgaccgctaactcctggctgcttgctctccctaacagcctgcgatgccccccaccagcagtgcacgctgccatttgctacacgcccccctccccccacatcgctccaaggcacccctacccaccgccacagacagatacgtacacgtcgttccagcactgtgcggtacctgtgccagcgtgccgcctcccgagacgaaactccagacgggctgtccctgcacagtgcgccaggcaatgaggcggcaggcgacagagcgctgtgctgctgcgccttgagcacgtggcccttgtagtggtcaatccagcgccggcattcgtcagtgattgacagcccggggaaaacttcgcgaacaaacccacatcagcaaacgtcaatgctaagttctacggtttgtacagacccaagatgcatgggattctgcaactgggcgacgatcttctcccgtgccttgataatgtctctcattgcttttccgttgtcttctcccccttgctccattccctatgtgggcggtatcgagtgtaatgacatcagcgagctgctctacgttatctcagaggctggaggaatgcacaccaacattgacccatcacgatccaccctcacagcgagacaaccctgctacaggacagagggctcctcgctgtaagcaagcagatacagggcggttgcggatgattggctggcagcctcacactgtcctgacaaactgtgtcgcaccgagtttggccagcgctagcaggtcacgagacggctagcgggtggacctgcagggcgctgattggccgtgctacccagaagtgcgctgactgaacaggtgcagccttcgctcgtcatcactcgttcatcagccatgcactgaggggcaacacaggtttgggtgtcggcattatgatgctttggtttgcattccagtccgctcagcctggccgtctcagcggcgatctcctcttgtttcgcttgccttgtgctcggtacattcgctttcaagacaagacagccagagtggcagggctcgagacacccgcatcagcgaccgagacaagacaagggacggacataatcaccaagagacgccggggtacgattcacgaattcatgctcgagatggttcacttgccaaatttggtcgagatctgtgtagcctctccagtcaatctcgtcgctcctactaggggaccctctctttcgctctgcccctcactccatttgagcctggtagagagaacatggatgatgggagcatggaggggcagattggcaccaccaccaatcccaaagatacctttgttgccattggattgcgtattgcgtctaacagcaagcatactcctcgggtctggcttcccacgccggccagccgcccggtctccgatggctgaagctaattctatccgggtggaagtcaattgcagctccttgcgagccagtggtcttacgacactgccggctcgtgcataaaaaacgcccgtccaaacgtcaaaggagatgcaggcgaaagccgcctcatgcatgcaacagccgatgccagccatgggcacgtgtgtgggcgataagggaaaagtacacctgttctattcttcggttccgccttcgctgctcccacgcaacctcgctgataaggatgccacctcctactacttgagcacgaactctgagcccctccttcatccatggcttcggccgtggggcactaagtttaagcatatttcagtgtctggccaagggcatggtcaatgggccaatcacatccccacctcctacacctccgggtcacgtattcatcaaattgaccatcaggagctggaaatcatggggtcatgagggggttgctggtgccccctccatttggtaggtgtttggtgatcagaacaacatcggcatcgttgtatccagtaaggtcaaggcgggggttgctgtgccaagtccagcaacggacagactccgtggctcgtgatgttgcggattttgcggccacacccctcagatcacgaaaacgaaaactggctgcgctagccggtccaaaggtctttgttccatcgagatggcacatcattttcttgttttttttttttaccccctttcccatgtttgtggcaacaggaaagataaaaagcaacgaccaaatgcgcatccacgctaagcggtgtgtagcgtttgcaccgtcgctcctccagacgaggcggcctatctacccggatgcgagttccgatcaagctgagccttttgtttcgtgaccgcttcgggctttcgcacccggataccagcattcgccatccaggggtcccgatatttggaaggggcccttgtctcacccttgcacccggcgcctagttttggcccgcgtagaaccacatggaagaggccgacttgacggcgccgtatgtccgtactgtatcccacttgctgtattggccctggcgagcagggcagtgccacatccacccgagcccgtcgccgcttggcccggctgtgtcacccaagaggcgggcggcgtgtgattgcgtgggcgtgcgtcatgccggcacccggaggcctcacagcgatgtgcgcgtctcgtttccccatttcgtgcggccaagcccgtagcaaagttgtacgacaatcccacgcatgccaggcttgccaggtacgtggaacctctacgagacaacgaggggtatgatgggagcatcctgttgctctctccacttgaggcctcagggaatatgagctcttggctcactgtggcagtatcatgtgcgtatctttttttgaatggcacactacttttcattgatctaaccacacaatatccccaactcaagttcaggaagtatgcttcaatatctgaggatcattatgttgactgacttgttagacgcttgaggaggcagtaattctcagagcatcggtcgttccatcaggatatgcggctcgaggcagcagactgagacagctcccaccacaatcatcattaacatccaacccaaagttaattctacgccatccgccaataagcataatagatcgtccctttttcgggcaatgtccgctcagtagaacattaaccataaacgaccccgggccatgcccctcccaagaacagatgggatgggaccaaccccaaacttccccatcaaatcatgttccacctgccccagctgcttattttgagcaccgacatatcctccgaaggagggggaagagaaaattatctaccgacgggaacggcaagtataacgcaaagcctaccggtcgccggtaatgtccgtcgcaaatacgtgtcacagccggctcctctcctactgcagactaacccgagctatcaacacgttacatcgcaggtgaattatggtaagtctacatgggagaaatgcctggtcgtggtgtgagatgtcccggcacgtgttggtgtgtttcacccagcacatcacctcgggcatttaccgagacgtcgcttctgccatgtcttgctttcaaactcgcactgaagacatgggcacacgccagagtgacatggtccttccaaatagcgtaaatattgacttcctacgtacgagtatcattgaactaagcgagctgctaaacccaattctttggggtggaaggcatagcaagacgagcaatggccctcgctacagccaaaccatgattcccagcctccttcttaacccagcaagttgatgaacggctctggccagcttccccagactagcggcttatcaccgagccgcccactcacaggcgcaagaagctttatcttcttcctctcctcatccacatcagatacgtacacaaagcccatgacgctggacgcccgcactgtatcgggcaggtctcgagtcccggcgctcattatggcaaaagtccaatgctgcatctccaccgacgcctcttcacgggcgaatccgttgaggacaactgcaggttgccacagttagcccaatcaccacttatcacactgcagctcgtaggcgcgggggtgtagggggggaaaggggagagaagggagagaaggaaaggcaagttgtgtaggaggtgtggggtacatactctcagaggccctatagatgaccaagctgtcgaagtcggcctgctggatctgaggacttaacgttctccgagcatcgccgaagaagtactccttgatgcaggcctccctgacatgctgcatgaagttctggtcccggtgcgccacgccgtccgacttgtccagcaggacgatgtcgattggctcgcccaggcttgtcttgacgcttgtaaatctcttcgcgagctcctgctcgagcaatggcgtgcctatcacgacgacaacgttgactggtggacgtcgcaaaacccccctgttagttccatattgatcccatgctatccccatcttcggcttccatcgcaacacttactagaaaactcctcaataatatgagataggaggtcgacgccaagctcgctctccccgtcaacacccatcgtatccacaatgacacctgaccgcttcacgtcctcatcctcgctcagcctggcgctcacgctccccgccaggttgctcgccagctcccggtagaagtcgggttccttctctggctcactggccccgtagtagtagacgagcggcagcttcacgggcaccgtgctcggcccgctcgtgggcgtgcccccccagccgtccgtggcctcggggtccatcaccgtcgcgaacacgctcgcgctcagcgagccggggaggctcagcatcccctccgccgggtcgaggttgaccacgagcggctggccgccctgccgcgtggcgtagctggcgagcgtgcgcgccgcggtcgtcttgcccgtcgaggcggcccccgcgacgaggacccgcggagcctccctcctctcgcgggcggcggccgcgcgcatgtcgttgagctgcgcgtggaggttgaggagcgcgttggcggggttgtcggccgggctggcgtagggtgcgaccgagtcgtggtcggtgcggccgtcgacctcgatctcgcagccctgccatgtgaggatcctggagcgggcggccctgaatgtgtaggcgttgcggggggcgagctcgatgccgtccttctcagccgtgccggagacgatcttgatgacgaggggcgaggccgtgggggcgtggaagcgccattcccagcctggtcggagggcgacgatgcgggtagaggcggtctcgggctgggagggtaggcgtcagtcagcttggtgttcctcgcttgagaccagcgggagagacatgtggtcggttgtctggtgaggagggtagatagatagcttacctgttgcgggatctggcccaagcctggaatcgacatggccgtctacatgggattggtgaacaatggaaagtttagaatcgcttttctcggtggggagctatagctcgttaggttggagctgtgaaactggagctactgtcggtctaccctagatcatgaacacccaactaactgacttctcgaacctcaatccatgccatgaagtttacctattcataccaggatgtacccgggacctaatcaagcatctagatcctacaattaaaaaatcacagaatctataatagcctagacatttaatccggggcctaacaggggttgccgtacctgaccgcctcacatcgcttcgaaatgaccaaatccactcttctccctcacgcctcacttctccagatccaaggcggagcacgtgtccccaagacatcaaatctttgccagatgataatccccagggaaaaggcctagagcgcacgacttggcgaaaccgcttggcggaacccatccagactcgtcgtacagtcagcggcgtgtcacggtcctactgtgctgataccttgagtaatctgggtcaggttcaggtcaccctcgcgtcctctactgctgcttgattaaaccactggcattctggacggaaaaccggcaaggccctgactgagattgacacatcgcgggtggatatatgcagacatttccaggtagggcattgcagccgccggctgtgatgggtttaaggtgtccagtccggccgagacggtttcggtatcaaggagacgagaaggtctcgcggcagcatgcatggtgatgtgatgccgtgcactcgcaattgcgctatggccgtctaggtccaagtgtggacgaggttggcaagatatgcaatgggggtttgcaaagcctcagtcatggactcaccacccccaggcaccccacgatactggttcatggttgggagacagtgtcactctagacatctccctacacatttgactgtgatgtggtatacccaccgggggtgtgtgttcttgaccaccagctagggatgtctcggcagaggggggccgtccatcagtgattagggtcctcaccaccgatcgatgaccggagaaaaaaggtcctggggatggcgcacactgaggctgtgacttggaatattggctacctgcatgaatctagattgcggtggaggctgctagcagcatcgctaccagcagcacattcagcttgctgggtcctaatacatgtgggtattgggctgaagaattccatggcagatttgccctgcaggcagattctctcagggtgtttgtgctcaacgaagagaatatcctggaactgccgtctgaagtatgatataccggaggttggtggaaacggtgaaagacccatcaagctacttagcagacagtttctgctacaattccctttcccctgcataattcagtgcattgcatctgcatcttcaaaaaggcatgtttgattggtgtgattctggttatgtttcttacgagtacagagcacagcatttgcccttgagttaggttggtgttcggaaggccgcgtcgtctggaaccaacaccctctgacaaggatccaaactatccagactgcatcggtgttcaatactaatgtgactcgcactcccatcaggtacttcatgctcatacgcgcgtcatcagaattgcaacatcaagcgatgatggtaagtgggggtgtaaatagcatattgagattaacttgtttgacggagatacttgtattacgatacaacgccaagataaaaaagccatcttggcgaaatctacgcgataggtgtctcaaatgacgtgtgcccgttgcgaatgtgtgttaccttgggtcaaggtttgctctaaacccgccggtgcgctttggggagcgactaatgctggcggcaaaccttgcgtgtcggctggagggaaacctccggctcgatagaccagagaggcgacgagatgtcatctttggacttcaactggacttcaactggatgaggctgaggataaactctgttcactgaggtttagcggagaaaagatgaaacggcaagagtaagtagccacaaaaggatatagtgatcaagactagactggtaggaattattgaatcaattgctaaactataattttgtcataaaaatcgtaacaccagatggactacctgagctctaatcataaaacagataaacaccataaataaaacactagagggcagaaagcgaggtaacctgcacactccacgccgcctcgcgatatggggtatccgtctctgacgccgtcgctttgatgagtcctggctatgagtaaaaaaagcatgtaaagcctgaaaacctgtttctctttgctccaagtgacgaggggccgaagaaagcaatgtgtatgtcattaaagctccattgaaagttctcgcgaaaagccttttttctatcgatcgactcttttgctgtatttttttctttttcttttcttttttgtttactcggttgccagagtttggaagatatcgcggacgctgcgcacacccttgagcatgttcttgtccgggccctgcccaggtacccatgtggcatgtgcgaagtcgatcaacttgactgagaagatgggtggaagcgatttcatcgcgttctctaatagatcgtcgtcggactcctcgtcctcgatggcgatgccgctgtccacacgcttagttgttaggagcctgtcggaaacgctatcgacgatggaattgttcttctcaatggcactgcggagggccttgccgtcgccctcgaagacgaagaggagagaggcggagtacatgcgggtctcgttctgactgagaacctcctcaacgttgtcgactgtctggacgaaggccttgcagacggcctggcccagctccttgtcgattccggcgttcttgttgaagacaaagtggcggaactcggagactaggttgttgtcgttgacggagaagcggccgtagtccttatcatatactcggtagtcctcgtcgtccaagtcggctgggttatctgaacccttgtacatgcgcatgccggcgattctgaaaccgaagttgcgatgcgttgtctcctccgagatcttatcaaacttgaccttcttcttctccggggcgtcgtccgcccacaggcgaacgccaagcttgacatcgaggatattgggcttcttgaagccgtatgtgttgttcaccaagacgacagccttgtttgtgctgatcttgccacccttggtaggaacccattcgttgtctgcggcaggggccgtctcgggggcggcgttgcccgcggaaatctgcttgctgacagcggcggtgatctggtccttgtcggtcttgacgttgccgttgtcggacacgacggccgcgacagcctcgcttgcctcgtcgagggtgctcagcgaaagggtgcccatgtattcgggcatcaggtcggagagctcgggatggtcgcgcttggcggtctcatagaagtcgatctcggcctggacgcagggcttgatgaagagcttgccatcctcatcggacatggtgccagcactatagcgggaggttagcggtttgcgacttgccgcggcgcacgcaaatcaatggcgcgcaccattgcgcaattgcgcgggaaaatacgcttactggccagcggcggcatggccgtaactttttaacgattgagggtcgacgaccatggttgtggttgtgataaatttacgtgaagggctgaggttgaaggaggcgggggaggggtgcacttgtattagtggggagagtagcgcagcgataaggcgacaaccactcgtagggcgatggctgtgggtggttgcctggagggaaggggagaatgggaagaagaggcgaacggtatttgaattgatttgggcgtggatgggctgaatgcagatggtggatatgccttggggattcccgacgggtctatatagtccgaatttactgcgggttggtcgagggaccgcagttgcgagagttgaaggggaattgcacaaagaggcggcgctagctaggcggtttcgaagagatggggctgtcttctgatcaaggggtgcaatccatggtccctgaatagcagccgcagccaaccagacacgcggaggccttggctcgtttcaatcagacctggtcggcacggcgtcaaagataccacaatgagcaaagtcgcctccccgcgccactggccgtccgggtctcaacgccaaccaaagatggcgatttttcgatgactgttctggtacgcggtactgcaggtaacgtgggggcggagtgcctgcgctaccctcccagccctggaatacgttacctgctgcccttaatggagctgatattcgcagttgctcattttcagtaattgcttgccgatgacagaaagtgtgccacacaccacaacacacagcactggcatgcggatgacagcccgatcggcattaacgcacacatttgccttgtgtagcgcatctaaatatgaacggagaacaaacaactcttcgcatcctccctcctttcagaataccctgaaacttgtcaaatgcaagagacgtgtgatcggcacacccgcgcactgtaccgcatccaggtctcttttttattttgtctaccccgccacagggctgtaacctgtcccttgtaggcgctccagctgcatttagggcgctgctgttagtgggtgacggccgcgacgggcgctaagcagccggttattggcgtgtggctgagctgccgacgggttcgggttggcactctgctcagccaccgcttgcaccctgcttgatttcttgattcgaccgctcacccgtgatgagcaagctggcttactcgaggcagatttctattcgcgccaatctctgttaccggtcttctatcggtgccttcagctggcctccagctagaccagccctccccctcgggcccttggcggccgtcgttcgggctgttgcctgtgccgaaggcccataagcttggcattaccgactcccatccatgcctacagccagccacttgccacgcagcagatgggatgagactggcactgcgtggcgtggcatggccttgcattgcatttgggtgttgagatcagattgcctcttgtgctcaccagcgtcagctgcacatcacccaccaacgcaccacacttgctccaactcctctcgtattgggctctgggcacacctccctctccggcgcagtggatggagctgtggatgcaggtgcagcggtgagcttctggttggcaacggcgtacgtacgtgcaccttgcaaaacggctcgtctgccgccttgtgcagttaggctgggcccttgctgacctgcagccctggacaagcaggtcatcatcggagggtcgtcgattcattttacccgacttgtgcactcgtaccacttccctggctcaacatcaagatggcgtcggggcttgcgtgtctatatcgggtgcgtacataatagtgtccacgctgctatgcctcgcatataccgtggcacagccctaggttgctttgtatctcggaagatcaaccaagaccggggtgtatgcatgtgtgttgccatccacatctcagtcgaacacgcaacctcagcccaatgcaaggagcctatcttgcacatgcggccggctgtctgtttgtttcgacacacaacggagactaatgcgggaagcctcaccctgctttgcgtcaccaaagttctccaccaccggtctggtgatgctgtctagctcggtggtgagttggcagacagcatctgtatattgcacatgtgaatcttgttgctcttgtatatttgactcgtaaaatataggaagtattgtcttctacctggacgttggtattaatggatagttctcaactgtctgctttagcgcaagcactgcgcaaactctcccgcgatgagacttagcctgctccgtatcgttcagcttcaatacctgaaggctaccaagtattggacggaggtgtgcaagttttactaggtcggcaaggtgcatgcgctctgccttggagggtcctgttcatcaaacacataaagggcacctgcgtgcgttgtataaattgcccgtgtgcaaccgtcgacggctgcgtgcgtagccactcgagtttctaaacatgtcccgtgctgcatggacaaggaggagaaaacaatggaagaaatagctgccttctctctcgtttccctctggtggcccgagtgcgaaaggtgcttaaagacaaacaatgatcccgccgctccttttctcccataacttcactcttgcctcgtgacctgcctccctgcgcacaacctcacatttccttccttgcaccttcccaccaccaccacaaggcccgaaacgcgtatcagaggtttcgaaatcctgtattctgtgccacttcccaaaatgcgtcgtgacatcccgccagcaaatgacttcaaccacagtgacgcagaaggcgacgacgagtctgactacgaaggccagggttactcgatcgaagaagcaatcggaaatggttcaacagcggcttctacgagcacgaataaggcacgaggacacaggagtcaggcggtgagaggaccaacagccctccccacgtaccgtggcacaggatttgagggtgagttttcctttccgaggttcgacaagcttctttctgatggcaactagagtactttgcggatcctcccatgacaccagcagaggctgagcaggaaaaggaggagatctattcagagtgagtgacccaaaaatgagcatgctgaacatcagatgactgacttggccgaatttgcggcacacagggatcttacttttgaacagtacgtagctacctcgcgcaactcttggtagtgaaagatttaactgactgatataggcgtatcgagaactgcatcaaccgctaccgcagtcgccgccgattccagcccgagcattcacgctacttcaacgaatatctctttcttggcggtattgacacgagccccgcgcagtttagaggacgcgacccgaaggctctcaaagaactcacgcctgctcagcgacggcaggccatgtcgcacgatgtggccaaatccctcggcggccgtttctatgacggcgacaaggagcagtgggtcgtggacttcaccggcgtcgctgctgggttcttctccaaccccctgctcgaactcaccggtgcagaaccggtacagttggacaaggcggctagcgttatcgagaacttcctgcgttacgtccttcagcatgatgtgtgcccagagtacgaggatgatgtcaagaatgccctgcagctctgcttggatgccaggtccgagtgggctgccgtcgatcttttgcagcggaagctccctggaaacatcaaccatgccgccttcaactcgttctgtgtcgatgaaaatgacgaggagaatggtggtgaggacaagatagaccaggagaccttggacaatgcgaaagtggacttcctgagctcactggcgctgctggaggacgacgccttgttcgccaaacactccaccggccaccctaaagaggtccattcgttcttctgcgatgtcgaggttgtcagcatccatcgcctggaggagcgcatcgcgaagaggttcgagtcgctctgcattaacgactcgtcgcttggactgaacccaatcggcagcgcgacattcgtccccacgacgattggaagtgatctggtcaacccccccatgccgaggccgttccccgaggacaagatgacactgtatttcgacgatgcccaccttgcgctcatgaagccgggtatgaagctgaagctgaatgtgggcgagctggacacgggtttccggtatatcaggatggttggaaccgtctatccgtccttctggacgtttttgccccaggagttgatgaagcacttcaaacctcccaggctcagtgagcgacccgggccatcgatccacacgttgtaccaggataccgaggagggcagtgaggagtgagttgggtcaatgagagttgttactgtgacagagcagtggtttgtcacggtcggcgaatgatcacggttacggtaaaattggtgcggaatcttcgatagagaacaagatagtggtaggcgctcgagtgatattgcgataaatcaaaacatttcatatgtgctatcatacacttcagcaccaaggtagcttcacacactggtactttcctaacgccttatccatcccgcgtacagataaaaaaaaagaaacaatcctctactgtgcatgtacagcattcgagtagttcaaatgacgtggacgcttgaatccacgcgcgcaacctcgatgaatgaagcgtctcttccctacatcaccagccgcgcaaaaggctaaacaaagaaaaaggacatgatcacgagtgagggtttggtcaatagggaaacttgcggaaccactaccgccagcccacacaccgcagaaacaagccctttgtctagtcgtggctctggaccttgttgtcgccagcaaccacctcggcgtatgaagggggcacgccctgattgttcgagctgctcccctcggctgcgtctgcgagaccctgttgctgaggcgggtgggcggcggcgggctgttgctgctggggcgcgctggcggtgccgtagttgacgttgttgttcgggcccgggcggctgctgctgccgccgctgcctccctgggacttgttggtgtgctggcagtggtggcggtcgatgacgatgtagcggacgcggcccccctcggcgtcctggggcacggggtcgtagtcgtactcggggtcggggaacttggcgatgatgtaccaggcgtggatgaggcccgggatgaagccgaggcagaggaggaggatgttgatgatggagtctgcgctgcagatgccgcgcttcacccagactgttttgaggcacctaattagcatttgcgtgcaatggggtttgtttatctggcgttgagcatgacgtcggggatcacgccaggcagcggggtgggatgggaagacgtaccaggtagaggcgggaagagaatggccaggacgcacaggaagaggtcgctggaacacatggtggctggactgtggttctcgaaagtagagaggaattggagaaatgtagtttttgtagtcttgtcgagagaatgagtgaggatgaagtaggatggaagtgcctgtggcaaagggtaggatagagtaaggctgtggacttggggcggacccatgacggatttcagaagggtttggctgcctattcccacagccgtagtgctcggttagcggtggtggcggtgctgcggttgcgtaatggccgcgctggatccgcctgcgattggctccagctggtcatatgcatgggtagatgacccggactcttaccgatacacaccgaaagcctgttctcggtgaatgcggtcatacctcggtgagcgagtcgcgacggaaattctttgagaaggcgtctcggctccaccccccggctagaacaatttctagcttccaaccaccaacaactccatctaggatctacaaccccgtcggcaggggctgcacatctcaagatggatgatcttatgaaccttgagcttctctcgctggtctccaaggtcacgtcagaactgcagaaccatgtgggcatcagcgacaagaccctcgccgagttcctcatctcccagcgtatcgagagcgacacgcccgatgtcttccgcaagaagctcgacggcctgggcgccgacttccctcccagtttggtggacagtatagaccgtctcgtgtgcgccatgcatcccaagatgaagggcaagaaagcggcgccggccgagccagaacaccatgttcggaccatggaggagaaggagcaggtattcagcggactggcgcttccggacaagcctgctgagagtggtagtggaggtgatgcgattgacgacacactggcgctactggaaggtctcgagagcaaggtgagagggtcgggagactcgaggaagcgcagtaggagcccgaaaccagaaagggattcaaaagacgagtctcggaggaagagacgcgaccgctcacattcccggggccgaaggaagcgagatagatttcgatcgcggtcacgatcgcaagacaaaggcgacgaggattggagggacggattcaaagacgagcgaaagtcacgacgcggccgaaggcgatacgacgacgacgacgacgacgaggccatgggcggttatgaccgagctcctccggcagaaatcgatgatgcgcctattctccaaaaggtttatcctggccatgtcacggggctgaaggattttggcgcatttgtcaacatacacaacgtcaggggcaaggtcgatggcctcgtgcatgtttccaggttgatttccgggcagcgagtcaaccacccctccgacttggtatctaagggtcaagacgtctgggtcaaggtgatcagcattgaaggatcaagggtcggcctgtcgatgaaggacgtggaccagagtacaggaatggatctggagccacaggcaagactcacaactggcgccaacatggaagctctgggtggcggcgcacggaatgggtttcaaaatggtactacggcggccatgccacgggatactttaggccccccacagaagcagaagaagagaatgacatcccctgaacgatgggagatccgccagcttattgcatcaggcgtcgccaaagcttccgactacccagatctcgaggaggactatcatgccacattgcgtggtgaaggagatatgatggaacttgaagaagacgtggacatcgaagtccgtgaggaggaaccccctttccttgccggtcagacgaagcagtcgcttgaactgtctcctattcgggttatcaaggcacctgatggctctatgaaccgagccgcgatgtccggtacttctctagcaaaggagagaaaggaactgaagcagcaagaatccgatgctgctgcaagggaggcgccaaaggagaacctcgcgtctcagtgggaagatcccatgatggatgctgaccaacgcaagtttgcctctgacttaagaactgccaggatgaacagcaagtcaggcgaggtgccagaatggaagagggctgtggaaagcaaaactcccctcatgcctatcaaacgcaccaacatgagcatcaaggaccagcgggagagcctgcccgtctttgctttccgaagccaagttattcaagcagtgaaggataaccaggtgcttattgttgtaggagagacgggttcaggaaagaccacccagctaacccagtacctcgccgagtctggttttgcgaacgatggaatgattgggtgcactcaaccccgtcgagtggccgctgtttcagtcgcagaacgtgtcgccgaggaagttggatgcaaagtgggagaagaggtcggctacagtgttcgtttcatggaccgcactagtcctgcgacgaggatcaagtacatgacggacggaatgctccagcgtgagattctcatggaccctgacatcaatcgatactcggtcatcatgcttgacgaggcacacgagcgtaccattgctacggatgtcttgtttgcgttgctcaagaaggccttgaagcgacgaccggatcttcgagtcatcgtcacatctgcgaccctaaacgcagagaagttctccgactacttcttcgagtgtcctattctcacaattcccggacgaacgttccctgttgaggttctgtactctcgagaacccgaatccgattatcttgattcagctctcgtgacggtcatgcagattcatctcacagaaccaaagggtgacattctgctcttcttgacgggacaagaagagatcgacacggcctgtgagatcctttacgagcgaatgaaggcacttgggcccaatgtaccagatctggttatcctacccgtgtacgctgcgctgccgccagaaatgcaagcccgcattttcgaaccggccccagaaggatctcgcaaggtggtcattgcaaccaacattgccgagacatccatcacaattgatggaatctactatgttgttgacccgggcttcgtcaaacagaatgcatacgaccccaagctgggaatggattcgcttgtcatcacgccaatttcccaggcacaagccaaccagcggtctggtcgagctggaagaactggcccagggaagtgcttccgactgtacacagaggcagcgtacgagtctgagatgttaccgactacgatgcctgaaatccagcgacggaatctgtccgtcacgattctcatgctcaaggccatgggtatcaacgacctgctccatttcgactttatggatcccccgcccatcaacactatgcttactgcattggaagaactctacgctttgagtgcgctcgatgacgagggcttacttacccggcttggcaggaggatggcggatttccccatggaccctacgcttgccaaggccctgattgccgccgtggattatgaatgctcggatgagatgctgacaatcgttgccatgctgaacctgactactgtcttctaccgaccaaaggagaagcagacacaggccgaccagaagaaggccaagttccacgatccgcacggtgatcatctcaccatcatgaatgtgtacaactcgtggaggcaaagcggatactccaacccttggtgcttcgagaacttcatccaggctcgatccatgcgccttgccaaggatatccgcaaccagctcgaggaaacgatgaagcgccataaacacccaatcgtatcttgcggacgcaacacgcagaagctccgccaggccctctgctctggcttcttccgccacgccgcccgcaaggacccccaggagggctacaagaccctcatcgaaggcacgcccgtctacctgcaccccagctcggcgctctttgggaagcaggcggagtgggtcatctatcacgagctggtgctgactagcaaggagtacatgcgatacacaacgagcatcgagcccaagtggctggttgaggcggcgcccaccttcttcaaggtggcgcccaccgaccgactgagcaagaggaaggaggctgagaggatccagccgctgtacaacaagtttgccggcgaggacgactggagactgagtgcgcagagaagaggtggaaggggtggcggcggcggtacctggggttgattattggtttgctttgtgcgttggcgttgggatgatgatctactggcgtatctatcaagaggcatcaaatgcggcgtttagtctgacagttttactagtgagaagccacttcctagaggacatgaaaataatagcgtattacttttggaatactgtactaggggttctcttccttctctgaccattcctcaacttggtgatgtgatgctggacatcaccgacggctgactaataaaatagttatatcacaattctcagctcatacgaaacaagccccctcaacttgtcggcaggatgacgcgcatggcctgaaatccagaaacgagtctcctcccgagtcagtatcaagcaaacgagaccgaggagccttgtatacatggctgaccagagtcgcccagccccgactaaggcgtaccaccgcaaagtgaagacggggtgcctcacatgcaagtaagactgacacccaagtctctgacaacgcccgaagtgagactaatgcacgaccgcctgaagaatccggcgagttcgctgcgaccagcagaaaccttcatgcaaccgctgcgtctcaaccggccgcaaatgcgatggctacgcccagccggccaccaagtcaccgtcaccccccggatcatcctcatccccttccccctccgcgcctgaatcccgccagctgcagatccgcccccggagactgtcgccggcttcatctgccatcacatccgccacgcccaccaggatcctgctgcctcacaaggacccagacgagctccaggtgtacagctacttcctccaggtcgccgcgccgtccatctccggcgtcttcggctccgagttctggctccgcgaggtgccccggttctgcctctcggacccggcgatatggcacgccgtcactgcgctgggcaccgtgtgccgcgactacgacttcaagacctgctcgacggcggggaatgtctttgcgatgcagcagatcgggacctcgctgcagcacctgacgcagcccaggtcggcgtcgagcatggataggtggcgggcgctcatcgcgagtatcctgttcacttgtatttccgtcgtccaggggtcgtactcgcaggcgctggtgcatgccagctcgggagccaagatcttccgcgagcttgaggacgaggacaaggtgctgcgaaaggggagagggggtaccggccgagcatctctatcccccatatcgttctcctccgtgcggtcggtcctcatcacgttccagatccagcagagcgtagtggaccccggcgatatcctcggctcgccgtcgatagagtcccacgacgacagctattcagcctggaggacgtactctgcgccggatcgcactgccatcccgggccatgtgctgacccccgacaacatcatacgcgccacccgcgccggggaggctctcatcttcggcttgtctttcttcccggcgctgtattttgaggagctctccgcgctcgtcgcgagcagggagctgcagctgccctcgatagcggcgaagcagcggagccatacgcgctgcttcaaggagattaggaagaccattgccctcttcgaggatgcgctgatgtctaccgctggagggttcaccatgggcgtggtggacagtagcagcagcagcaccagtggagcctcgatccgggcacagatcgagaaggcgctcaagtatttgcgcgtctaccaccatactagccgattgcttctgcatcgggatccagatgagcagaacccgatcaagcgtctgcctgttctgaagaggctgtccgagaccattgtcgatctgtgcgaggagctcatggatctcgaggcggcagggtttgggaacggcgacgggacgtatctcatccccagccctccgttgaccaacccgctctcgatggtggccttgttgggattcggtcccgccacgagacgacgcgcggtcgctctcttgtggaggcctagactcgagggagtgtgggacacgcagctgtctgcgagcatcatcgaggcatcgatggagcggcagatggaagcgaggaacgagtattatgctgctgtagaaagggaaggaggggttcttccgcagccggtggccagggggacgggggttgaggaggtggataatggggtgcatcctcagttccggtcggcgggtttctccatggtttttacgggtgagcggtcggcggatgtgtcgattcatatatggcgggatttgcttgatgggaagcctccgtatttgaggcgtatagagtggtgatggattcaaacatatgatgatggaatgaacttgctctccgatgaatgactgttgtgtatacccccttcatgattctaactcgttgtgatttataaaacaagtctataaattgaatgtacaagcttaaacataaggctatatatggctatgctctgatattcttctggtttggagacatgcgctccccctcagccgtcccttcagtagattccaaccccgactccggcgaagttgatttcgtctcatgtcccaacttcttcataatccatacgcggaaccgatagtgcaagcccaagatccctatccctatccagagcgccagctcagcggcgtacatgaccatacccacagcatcaaggcgaggggcaaagaccagcgccagaatggaaacgagatctcccatggcatcaagaaacacaaacatgaatgatatcccctgcacggagcgagatctatatatctccacgtagtagcggacgacacccacgcacagcagcacagccgccaggacagccatgaacgtcatcggccactcgatgtgcctgtcccgagccagccgcagggcgaagtacagaccagcctcgacgcccccgatgcccacgccggacgccaccacgccgatgaggatcttgacaagcggccattgggcgctgtagtacttgatctgggcccaggtgacaaggctgaggaagatgaggatgtgaggctggacctggagggcgacgttgaggttctggaccacgttatatgtgccgagggggatgccggcagcggcccaggagaggtacatgaggggatggaggccctgcgtgctgtggttgcggtaattcttgatgatctgggggaggagctgcaggcggtcgtgttagtaggcttggccggggtctcatacatacagtgtatatgtatatatatccctatacgtgtgtccctaatgccgtattgggagctgctgccccggggtgggattatcgtacctggatggaccagagaactgccccggcggttcccaagatgttggaggcgactggattgtccatggttttctcagcagcagtgtacccttgggcatcggaggattgaagaccaagtgccagcacgatgccgctgggagatattgtatcgctccatgtactttatatcaaatcgttatctttttcaagagcaagtactgctgtaatcggtaagaggctgtgcgagaagtgcattgcttttgaacaaaccaaccagccggaagttagagccaagagagacccacagcgagataagattgttggaattagcgataactttaactaatgccatgcgctaaattaaagagcgaggctctataactatttacatacttccaagcacgctcaagcactccttgaagccaaattgctggtccatctccggcaatgggaagaggagtaggcaatggagatcgccgggcatttcttcgtggaggttttctctgcaaccaggcctgcccgtggacttgcagggatggcagccatcatctgaagccgtgcctcgtgtttcaaccgccggaccggcggttcaacgacattcggacataacttttcatgaaggcttcgactagcagagacgagtccatgatcgcttctcacccgccgcccggcggaatatccatttgtatatgtagcctctgctctcccacttgaggcaaatcaagctactcttcgcaattctccttcattacacaaagctctcacttgtctatcaatcacctcccacgaaaagaccgccaacatgcgcattcgcagcacaatctcgaccccgaatggcatcacctggtactatgagcaggagggtactggacccgacgttgtcctcgtccctgatgggctcggagaatgccagatgtttgaccgctccgtgtcgcagattgctgctcaaggcttcagggtcactacgtttgatatgcccggaatgtcccggtctgtgaaggcaccacccgagacctacactgaggtcacggcccagaagctggcttcctatgtcatctccgtcctggatgctcttgacatcaagcacgctactgtctggggctgcagctcaggagcttccaccgtcgtggcgctgttgctcggttaccccgacaggatacgcaacgccatgtgccacgaactgccaacaaagctactggaccacctttcaaacaccgctgtgctcgaagacgaggaaatctcaaagatcctggctaatgtaatgttgaacgacgtgtctggaggctcggaggcgtggcaagccatgggggacgaggtgcacgcgagactgcacaagaactacccggtttgggctcgaggataccctcgcacaattcctccctcagctccggttaaggatctggaggctctgcgtgggaagcccctggactggactgtcggcgctgcgacaccaaccgagtctttctttgacaacattgttaccgctaccaaggctggtgtcaacattgggttgcttccagggatgcatttcccttatgtttcccacccggacgttttcgctaaatatgttgtggaaactacgcagaagtatctttgaacggtacactgctcacgatagctctgatacgacgtgagggagagggcaggcgatattgtacactggaaacgacagctgtccatagacctgggaaatccttggattattgaatggccacgggacaattagatggatcgaaactacggctctgtcggtgcattttagctactggcattgttccatacagttaagaagacataaaatgcaaattcgattcattcttggtcacatttcacatcaaatgtaaaagagacacctcaagaaagaggatcaattttgactaagtagactgattgatacactctcgatctccgccatgcttaggttgttggctcactccctctgcttaacccaacttactcttgataaaggctagagcctgctgcccgtaaatgttaacgtactgctggtggtggttggcatcgtttccgttgcagcagtatgggtccgccgcgtcacaatagctcttaaccagcgagggattgtatggcgaacatgtaaatccggctggacgggcggcaaactgtttgcaaattagctcaaccattcgataaaagactgtgaaaactccatgatcttccgctgccacttaccccgccagctgtacatgtcccaacattgtacggcagaccagcccggttatggggatcccccatgaagatcgcagccttgacagcagccaatgcatttcctgacagagtcgggccctggccgccacacagcgcgttgtcgatgatctgcccgccctgcgagtagccgatcaggacgatcttggtgtttgggcactgctggttgtagctcgtcacggcggacaccacggccgaggtgccctgctggaccgaagagtcgtagctcacgccgccgcagctggactgcccgccgcacgccgggtacgagatggccgccgactgggagcccgagtaggcctggaggaccatgttgacgaggccccaggacgtgccgtagccgggagacacggtggtctcgcgggcgccgaagacgtagacccccgggcacgattggcgtggttccaagggggttgcggccgccgtagaggcgaggactgggagaatggctgagaatttcatagttacagccggtcccgtgagttgttaattgaattgaaatcgagtaatccgagaagaagtaattcttgcgtgtttggttttctttacttgagtaagtctgtactgagggcgaaaattctccagcatcaggctggaactgtctccatttatatatgtagctttatgtaaatgaatatacatatattcagtttgattctattgctgtttggacgttggaaatttagcctgaaactgaccgacgactcaacaaggagatcaccctggcctcggcaaggcgatggatgggttgcgtcggatcgtgaccctccgagatcgagtcccccggaaaacttgcagtatacggaacaagaaaccctctgattggatcatggatgtcaaaatcgaatgtcttgggaataagggaacagaaatcagtcgttaagcatgtctacagggcaccgtgcagcgttatttcaagcctggataccgtatctttttagttactggatagcaagtatcgactatcagctgcctcttttggtggtgctgtctcatagtcaggcgaagatgatccaaccagtgacggttgataactttgaatcacaaaggtatgaaactatcccaagtgcaaggtccaattgggagtcctggctgaatacagaggctaaagtggcggtaggctcgatttaaggcagatcagtggtaccaatgctagcatctatgaaacctgatcaactgacgaagctcaattgggttgatgggatggaggctccggaatgtcatagcgcccacctcgtgttggagtatgcgaggcccaggttccaaaacgtcccctggatggaactggaacgctagcctctaaacagggtttcattgtatgactccatttgccgcaatgagatgccgtggcaagggttcggaaacaagtgccgcagcgtattcatgcatcccaccctgtcgagcaaggtactttagcccagggctgtaaacatcaatgggtaatatcacagctttttggtcagttgccgagttgtgtgtttctaaacgatgacctcgttggagccacctcagagggttgaacaggctaagtatggtgatcccttcaaaagacccaagtagggaattcgataatagcctaaagggcccatgtgcctcaattgagcctctagtggcagggaagatgtcgatcatgggttccacgagatcctcaattggatgtctttgcccagatttagtggtgttgcacggagctgtcgcccaagccaaggatattttgcacgagtggtccattgatgaagcaggttaatactgaatttgttatggaccgctcgtatcagtctaaggctgattctttcaactttacgatatctggaatcttccatatagtccagcttgtgtagtggtagacgaaatctaaaacactttttccatggccattccagacgctttgagtttgacgtgatactgcagagtggactcgtattcataagaggataagtgtttaggtcatatttcatagtatggtattgtgagaggcttccaccatttctccattggtagctatggtttatgaacttgactactaatctaagacggcataagtaactactttgaaacacctttcatgaaagtccatgggctataaagatatccagcttgactaaaccaagtatatggtagccaaaaccgccctttcccatcaagtcctatttctccccaggaattctggattaagaagcagccctccgtcactccattaccagtactaacggaatcattccagccgatagcgacaacgcaatgaccgcccgtcgcttgagctgcactcgtctctagaggcagtgacaagacgaaagggtcctggcggggatcgtagcccttggtagccagtgacgggaatgtcaagaatgcaaacacgacagggtagccagacttgatacagcccttccaacaattgatggaatgatcactcatgctgggatcaaggtgagggcgcgcatagttcaagcccttgtgcaaggtggcagcttggaaggcttgaaagttcgggaccagcgaaacaaagttctcgtcgtacggccaactgctaggcgtactcacgatgtctgtggcatttgcagcctcctgtggcacgcccagtgttgttacgatcttgatgacatcgcgaggcatggcccctttgtctaccgtctcaggggttgtagggggtgagctggcaagacgctcataaaattcagccttgacaacgccctcggacgatttgtcctggggtgttgcgttgtcttcagcatatcgagctacatagtgtaggaagaggcgcgaaggcttgaatgacggatccgccgcctgctgccgctgaagctcgaaccggtatgctaaagctatggcatttgaggtgcatgagttgacttgcaactggttgtagcagtgctttaactcatagggcttattcaggcccgttggagggttgacagtaacatcgaatgaaccagtcaagtcggccatgtccatgttcatcttcgccatatcaacatcgtgatcccgtggatcatcgatatccttaatagctccatttaggacaaaagacatgattgaagcggaaattggaaagtagagaaactaaatgtatttatgtaaagattggaagaggtttccgagatggcctaatctcaaagccaacacgaacagctataacgagggtgtgataaaagaattcaaagggaacaattcttctatatatacaaatatttggaagatgagagagtggcagcccaccagtaaacatgtaatatctctgtcttgttgatatcctgcatgagttccggactagcctgagcgacagttctgggctccaatccagccttgatgcattgccactattggttcatgtgattttcgtcgagtgcgattccgtggctcttattggtaaggcatctgagttggggcaattattgaagcgtgttggggttagggcgatgatttagtggtcatcacacctaatagttttagggcagatggcactattgctatggggtacccgttcgatatcactaaagcgtactacggccgcgacgtgacgtgccgtgccgtgggcaaggaggtgagggatcattgatagacattatgacctagatggagatcagagcagtctagacttgcaacgatactgctgcagctgtgttgtgcccctgtctggacccatggccgagtcccaatctagcgtggtatcgagacccagcgcagctgagaattccagccgactctcgtggtagtgaacgccgagctgacgcccggacgcacgtgcatctggtatcaggagtcctgggtcttatcactatgtccagttcttagactgtgactgagctgtggctgagcgatccagagcatgtcttaaaccggcagtgttttgttggataatgagccagatcaaactaacataatatagaaaacggaatcgattgtgtttcaggaatgactacaacggttgtagatgtcttggaggtccgttagcacctataaccgtgctaaattttaatacttcatggtggacagcggcccgccccaggcgcactaccagagcttaagcaacccacctccccagtaattggcctcccccagcacggagcttagtggattcagattggcgataacaagcgataagacagacgcgacagatgttgcacaacgcgatgtcacgtggggttattttacggaagaccagttaatccgcaagccgtaacctccgttggtccataccgcgcattgatcagggccagggatcttaaatgaagctttccacaagcaggaagataacctcggttaagtaaatagcggtttcttcatatagggagaatagctccttttcatttgtaagaagatatggtttttctaagctctgaaattccttcattggaagggcccacaaaatgtgtgacagttatgagcccgggtgggatctttgccccagtaacttctgctgcgcccttcctcttaccgatctttcttcccccttcatctatgctctcattgcaatagcaaaagcttcctgacttatactcctacctatactcaaagcttccgatcatggcagactccatcatgaagggagagattccccctaccaatataacccttcaaaatcccgatcattggtatgactggatcaccacgctgaagactatttcgatcagtcttggggtctgggaaaagctcgatccctccaagcccgatctcaaaggagatattccaaagctccccgagaggcctacgattgaacaagcacgcgagaccgcaatcaacaagcttcaaatcacacagcctagcgggaatgatatcgcggcaatctatcaaatgctcatacaagactaccaaccaaagcttgacaagcataaggaggataagcgcgcgatgcgaattgcgcgtgcctggatcatcggcacggttgactcttcgtggatgcaacgcgcaatcgccgcgctcacggaaaacaaggtgcaaccgaaagcgccctctgaggaaaccgagcaagtcaagggcgaggaaaagagcgctgctaaggagaagagcacagttgaagaagaggttattgaaaccttcaccttctccaatcgcgccctagtcaaggaactcaagaagagcattgcgcccaatgacgaggttcttgaggaagtcgcccgatcacgctatcttgcggttctaagctcgggagcagaggcttcaatgaaacccgagctctggctcaagaagtggcaagaagccctgaacgcggccagactgcatggcctcccggaagtgcagaaatggcacgcggtcagagctttcctgaacgccattcagaaccgctacgctcctgagtgggcgcaacgccgatcggaagagctagaccaagcgctgcagagcaatgacaccagcaagaacctggattattatggagagctgttccgcttccacatcgcgaataacacatcgcgacttcagggtcgccgctggggtatacatgccaccctcggcggaaggtctgacgagctttcacacagtgataaggcctcgtcagagcacagaagccgctcgaacaatcgcgggaagccaatgactaagtgcccttgcaagcctcaagccgagcatcgctggaggccggaagattgcttcaacctcaaagccgctttgaccggcaggggtcaaaacggcagagcttctcctcctaagcacgtatgcgatgaggtcaaacagcgcatatcaggcaagaaatgggcgtccctcaaagaaaccctgacgaagaaggggtggtttgaagactctgacgcgaatgcgaacgcgctcgagggtaggcaattgatcaatgcgatcattgatccctcgcttgttgagcgcccagcgggagaaggagtgtattccgcgcttttgaacgcgcctcatcctctctccctaagcacgctcatggataactgcggcgcgactcacctggtgaacgatatcgcgctccttcaggccgactcaattgtccggcctaaggagcttgaaaccgtggaagcaggcgctggatattttccgatcattgctagaggcacaagagtgatgcccaagcttttgaccgggttcaatggacagaagatggatctagtgcttacgaatgtggctgttgtggagggatttcacgttaatattatctcggcagcgcgcctacgagaatcgcacatctggtacaccaacttcgatgagtccctacgctttggagagatgagtggaaagagccatacggttctgaagcttacgaggaaatacaatctcaccttcgtggagcacaagccactgtcacaatgactcgaagccaaagcgcgcaacgaggtcccgcgctccttcgcagggattgtagcctctcctgcgatcaaaggaagcataggagagggcatacggaagcgcgttttcaaaccttcgtatgacccccctcggccacgatccgactccgaagatgtctggcacaagcggtcagggcaccttgggccagaagcgctccgcgagcttgtgaagaacgcgaggaatgtgcaaattgacggaaccaagcgtattgactgcgagatctgtgcttccacccatgcgaaacaggtgatatcaaagcgcccgagagaacacggttcgccgcgccccttttggcgcatttactgggaccttcaggactacgaagagggatacaacggggccaattggctgcttgtgatcagggatgaatactcaggaatgacgtatgcgcaaccgatcattaacaaggacttatatacgatctggagggtgttatatgcgtttgagcgctgggttaagcgccagtttgggctctcaatctgcaagattgcacaagatcgcgacaccggcgtcattggaatcgggagcgatacgagatttcaacgctgggcaagaagtgaaggcatagatctcgagcttccacctgcctatgtgaaagagcccgtaggaggaggagagagagcaaaccaagaggtcaccacgcggtcaattaaacttatgcactcggcagggcttccagttaacttgtggccagagagcacgcaagcgtcagcgcatttgataaatatcagcccaagcttccgaaaccgcgggaaagcgccaattgaggtattggaagcttggttcaaccaatattatcgctggtttacaacgctgccaataaggaagcattccgcggacttgaggcccgactggaacaacatctacgtatatgggtgccgcgcgtatcccctgagagaagaaagatcggcagatcggatgagacgctactttaaaactcatcaacgagcacatattgggtatctggttggttgggtagcaaccaatctcttcagaatatggataccaagcttgggaaaggttgtgaccacaagagatgtgcgattcaacgagcaggtcttctacaacgagtgggaggaaagcgcagctgcgctctcctcagcggaggctgacgagctagtctcagagataactgagaattccgctccattcgacctgttatcccaactggaaggagggagtgtagagtcgagggtggaaggggagcaagatcacagtattagtcaaagcgcggaagagacacaggagctttcagacctccagagtgttgcggccgacgctctgaaaagcctccaatttcatgatccccctgaaggactccaaactcccccaaagacgccaagcagcctgggtaatctcctaagtcctcgagattacagcgcaccggctcaaaggcttgataatgaggcaagcggtttagaaccgcaggcgcctgagatcgattccaataatgaatcaccagacgcgagggctggaagctcgcaagagctttcagatcctgaggaatcgcaagagggattaggagagctggtggtcgcaccccagccaattgagcctaaatccaatgattcactgtatccagagaagctcttgaaaagggctctcgagatggatgaaagcgcccaagaagacttccctaagagaagaaagcttggagcgttttcaacctcaacttgcgcagcagatgttgaggaggaggattggaatgacacctttggctatttctttgcaacgcaagagactccaaagcgcgcatataatgacaagcgcttccttacagtcttctcagtgatcgctgcagcgatgactgatctgcagagcagaagtgcctttccaaagccctcaaaggaaggagaaaagagggttcactttacagagataaccctcccagcgccttcaaactggaagaagctccagacgcacccaatgaaagcggacttcacacaagccgcgcacgaagagatacgtgctctaatcgcgcgaggagtgtggcgagagatggatcgtgaaagcgtgcatggaaagaggcctcttcctctcaaatgggtattcacttataagtgggatgcagagggatatctcattaagtgcaaagcgcgcatctgcgtgcgaggagaccttcaagaacactccctcgaggagaatacctatgcagcaacgctcgcagcgcgctcattccgtatcgctgctgctctcatggctcaatttgacctagaggctcatcaattggatgttaagaacgcgtttctgaacgcggaaattgatgataaagacggaccagttatctgcgaacttcccgacggtttcaagaaggcaggtaagtgcgcgcttctgttaaaggcgctttacggcctacgagatgctcctctcctctggtataaaaccttctctgcaaagctcgtagagcttgggatggttgcgaccccggaagagccctgcctctttcacagcaaggattataagctattccttatcttctatgtggatgatattattgtcctctatcacaaggataatcgggagcaatgtacacgcctcatcgaagatctgaagaaagaatgggagtttacagaccaagggccggctgagtggttcctggggatccgaattcaaagagatcgcgcaaggcgtaaggtttatctgtgccacgacgcatatatcgagaaagtggccaaacgctttggtcttgacggatctacgcgttatcccactattccgatcccagtggagggactctcaaagcgcacaacgcaggcttcaaaggaagaggtcaagagatatcaagagaaagtcgggtctctgctgtatacggcgatcactgttaggccagatgtggcatacgcggcttcctctctctcgcgcttccttacgaaccctgctccagagcatgagaaggctgtggaccaagcgctcagatatcttctgggcaccaaggaggtctcccttcaatacggaagtgatcccagcgcgcaagggctgttcatcgcgagtgacgcctcgtacgctgatgaaaaggaaactcgccgatcatcgcaaggctggatcgtaagcttgtttggaggacctgtgatctggaaggccactcgtcaacccacagtcacgctttcaaccacagaggctgaagtcctcgcgctcagcgaaaccgcgcgcgagactatggcattgaagcgcttgtttcgcgatatccggctagtgatcgagggagcatggaacatacggtgtgataacttgcaatctatccgactggtggttggagagcgcgaacgcattaacacaaggcttcgtcatgtggatatccataatatgtggctacggcaggaattcgcaaaaggggagttcaaagtcacatatctcgcaacagctgagatgcctgcggatgggctcacaaaggcgctttcaagacagcggtttgagcacttcagagctttgctcaaccttggaagtgtggaattggagtcatctacgaaggcattcacacaagagcatcacgaagtatgagaggagctcgcagggagctttcgagggggggggcagccgatcgaaaccgactgcctagtacattatgaaagatcgaatgcgcaccgagtcaccccccaaagagcaaaacgccgaacgccccaacgcctaaacgcctgaacataggaaattacatatgaaaacgcgaaaaatcaaagagcgaggtcaacagcggcagccaaagctgccttcaacttctccttacgctcctcaagagaggtagcgacttccgcagcaggggccgaagcttgctccgttgttgcggctgacttgagaaaggagccttcctcctcccagatgtgcacaacacccttaagggtggtgtgcaggatcttacggatctattgcaccaaagcgcgatagcagttagcagagatcagagacaagggggtcagaagcgcggaaatcacttactcggtcggaatccccctcagagttcagcgctctctcggcaaaagccaaaacagcaggaggactgcgttcatgcggttagcttgagtaggaatgaaagcttgaagaggatgaagagagcttaccactcctcgcagccatgattgttatcatggcaagccacacaccgagcggtcttgttggaggaaccagccctcttcccaatgcgctcaaagcagtgaccagtgccctttcccgatgcaaaggagcgtacgcacccatagcacggcttcgcccgtcgggcacccctctcggaagaggccttcggctatgatgaatgattagttgagaggccaaagagagagatgaaagcgcgcggataataccttcttcgagggggtaccctcagggcgggattcgccacgggactcaccagcaccgcgcccacgctttcgcccgctactctgaggggcttcaggaggactgtttgacggcacaggagagctcgagcgaggggagaccagcccttcatcgcgctcaagggatccaaaaggatccgagatatcatcacgcaacgcctcatcctgaccagcaggaccctggcgctcacgctcagaaagcgcacatgccgctagttccatcagcgcatccatactgaatattcaaagattgacgatgaataagagcaggctaagatatgaagaggaatgcgtatagaggtttctaatagtgcggaaaatgctttatctgaaggtctgaagaagaaaggaaaggaaagtgaagccatcgcgagatcgcaagccttataaaggacttgcacaggccaatcagagcgcagcagctcacttctattgtgcgttgaaagcggcattgtgaaggagaagtgatgtgagagaaaagtcagaaagctctcaccttgatcatggctgcaaaaatgggcgccaattaacgatttaattggtcaattcggatgaataacgcattcaagcctacgagacaatagcgctgcaacgttcaaacgctattcaatgaagggatagatgctctatgaatcaaacctcctgacaatgcgaggtcgcagttgaagttggaagggtgaatagcttcaactggagggtgtgttgcacaacgcgatgtcacgtggggttattttacggaagaccagttaatccgcaagccgtaacctccgttggtccatgttggccgaaaaagtatattgatcagtatgtgatacgatactgcagtctgccgtatgcaatcccgacagtgatagaccattggcatggacgatcgaaccccatgctaattcgcttgtgtggatatctcggaagaagccaatcataccggttttagctcgtgtcactttgtttcgtatctcccccggtgcaatatccgttagcgtagacccatgagcaaacatctcacctcgtaaaattgaaccaatgaaaaggcagcctgttctcgcataggcttcgaaaaccccttttaaattccgcttatgcagttgaattttctctaggacttacctatgagcagaaagtcctagcggtgatcccgagccgccaaactagagatgtgcgatgttgagtggcctacgttgcattatggtctacgatcgccattcaaggagttcgcccatcttctccaactacaatccgcattatgagatttcgccagcccgttgttttctgcacattatccccgccgaaaaccgagggtttgaagtggatcattggttgatgatagagtgtggaacgcacgcgatgccgttttggtgtcaagaagtttcctgagctatatttatttggaaacccaaggatgacttaactggggaaagagcgcgctacaaaacttgtcgcaaaaagcaagctagtacactatatcggttggctgtctgtagaacactagcatccaccttattctgcactcttgttcttaatctcctttttccatgttacctgctgtagccacgacctcaggccgagatagcttgtacgatggtaagactctcttaaatggctaggttttcctaattaatcattgccacaggcatggatgctagagatcttgtaaagaagcttgatggccttccgcttgcccttgtcacggctggagcatacctcaggcacgttgcggccagcttcggtgattatcttcgcctgtacacaaaatcgttggcgaggcttcatgcaagcaccccagacttgggatcctatcaagaccgcacgctctccactacatggcaagtctcatacgagcaagtacaggaaaaaaatgcactcgctgctcatttgctccaatggtgggcctattttagcaatgaaagacgtgtggttcgaactccttcggccttatgatgatgaggatacaccgtggatgtttgagctgaacgatgagctaaacttcaatagcgcgattcgcatactgcatgactatgggtttgtcgaaccgcatagactaagcccagacttgatcgagtcaaggggatacaacattcatgcatgcttacactcttggacaattcacatattgaatcaggattgcgatggtgatctgaataggcttacgttaaaatgcatagcatcaagggtgccgtcacagaatgatgataagttctggctgcttcaaagacggcttttatcacatgcgatgatgacttgcgccacaatccaggatggcgatgaaggtctggattgggctttcttcaacctaggtctcctttactccgaccaaggcaagatgcaagaggctgaggaaatgtacttgcgggcgcttcgagggtacgagaaggccatagggccccaaggttttgcgagataccgaccagcaatcaatactattgtggagaagagaaagtctctcctcgatcctccgcgcctctcccaaccatctgtatctctattatacctttgagagcttaaagctcctaggcatctgctcctgaaaaacgcccttgggatcatacgtgcctgcgacattcttcataaagtccaagttggcttttccgtaagacttgagtgggttctgcgttttgtccgcataattgatatagagccactcgacattcccattacgagacttggcgaatttctccagttcccggaatgacttttccagtttcttgtgcgccaccttgtcatgatcgggatctttgtacgcgacagtgcccaaccacaggatcgaattggtcttgacggcgtcgagacccagcatgttgccgcctttacgggcgccaatggtgccgaaaaaggacgggataggctgcaggacacactgcgttgaaaaagccgcggggcccagcgtggtcttcagatcggcggccagggcatcgtgcagagccatggcttttttcaagatcgcgatgtcgttgttgaatgtgagcgtgaaccagtggacgctaaacagtaatattgatttatcagtaagtggtgcggaggggaatgttaatcgatcaatccaggaaataaaagcttaccggtcatcgctaggatcgatgccgttttgagcgagctggcccagggtcgtgtgctgggaggtagcaacagtagaagggatcgctcggatatcgttgaagacaggggcgttctccagattcttggtgtcaaccataacagtgatcataccgattccctgtggtgtgacagtgttgtaggtcctgagcaccaggcgggcagcctcaggattgtcctcattctcattggtgaacttgacgagtgcggcggccgcctggtcgccgacgctgccatcatggatttgggttgagccccagacctcgggtgcggcggtggtctcaatgtcgaagcgggtgacaacgccgaagtttgcccagccgcccttcagagccctccataggtcggcgttggcggtcttgttggcgttgacaatggtgccattggcgagcacgacctcgaagttgaccacggtgtcgcagccgaaaccggtgcgggccgttaggtaggcgttgccgccgccggtcaggaagccgccgataccgacgtcagcgtcacgaccaccggttagggccacgcctgaccgaatgcgccgcacagtcttgtgtgggagcggtacggtgcgagagtggtagcttgcgagcatgtgaatttccacggttcaccagggcagtggaagggtatgtgccatcgatgtgagccgcagcacgagcatgcatcagtatatctcagtacctctcatgcaattcgccgccgttcgatactggcaacagcgcgttacagcgtatcgcgcgggtgcgtctgcgaatgtgtacacagaccctagaacaccccacgttacgcgcgattgccgacttcaccggatagaggggtagtatcgtggcaggtttggttggggggcatcgtgctgttgccaacagacttggaattaggtgtgtgcgcggcccaatggtcagtgggcattggcaaggatggcgatattacgactgaccaacatatggccatctggtggcattattatgtcagtcgatgtcatagactccacaccatcggatgatggtgttgccaggggtgcggggctcaaattgagcgtggtgtcaatgttcgtcacaagcgagtaaaatgtaagccacttacgaagccacatcacatgcttagcttctgttaatcgatgtggctgtacaggctgcggcgctccatctcttcgcgcgcccaccagctgattatcaacactaaacgtcagccgcctccacatgacgcatcatgctcatggacgacactaacactgaagaactgcgggcccaactactgcaggaaaggagtcgacgagaagccgcggaacgtgatgcccagcacgaacgtcaacaacgtgaagaagagcaacggcgacgtcgagaagccgaggaacgcgcaaacgcatccccaccgctgccactccagcaagtcggtgacagtcttggggtccagtacattgtggctgggatagaggggtgtccagtcgatccgcgtagtgctacgtgtactcgagccgccggaggacaacgggtgtgtgctcttgaccgtctggcttttagccgtcgtcgtcacagacctcctcgcgccactctccaaaaggaccggaggctgacgactggcgacgcctgcctaggcagctcatcttacgttgcatactgctggtaacagcgaccgggatacatcatcctgctgaccccctttcataccgtgggtgaggggggtatcgtctttgtgcactcacggttgacttgtttctgccccttcagacattggctctcgccagacggcggcctgccgagggggcgtaggcatctgggatcattatccaagggcataattggtttcttgttatcacgacgcgagagggcaagaagactgtttgctggaataaactggtcttgggtgctacggatactatcgaggggatttgtaaactcgtgtatggacttcgggtcttgcgtgagtgggcgagggatgcatactggcctgcttttcgccatcgtgtctcttcggatactgatgcatatcaagagtgactaaagaaggaggcggaggctcaagtaaaggcgcaagaggcagcgcgagaagcagcggcattagagagagaagtcgttctaccgtgataatggtggagtgatgatgcattatgacaagtgtcgatgtttttggttcccagcgtttgaagaattagttgttaagtcaaaggatagcgtgttttgatctgtacaaagggtgtataaatgaatgaatgaatgaagtatattacgcccgggagggttcatctcatagggccaagtgcgttgagctacgtacaattcgacagttctgcccgcatcacaagagtacagccaacagcatgcatgcaatcgagcgaaggtggctgacgggactattttgatctagtctataccatggtgcagctagaagaaacgaggttgcagccatctcatgcatggggcagaagtgtcttggaggagcgtttacaagatgaacgggccgcctggcatataagaagagcaacagttcgcctttttccgcccaaaaaatccccagctcaggcacattgatcacaattggccatcctgctcacaagttatctacaccattgagcattgagaaattcctattgtactgtttcatctcaaatcacatgccatccttactgtcctacaacgatcacaatacaaccgggtgacctcacgacgagccaatcagacttgatcaaagggttttaatggcaaggctgagctgttgagtttaggttcgtaagtgtatgccgtcatcttgctccctctgctaataacttcccgtgtttaagttactggctaatagacagcggcagccagattagtcacggtcattctacgcgagctcagcattgttcagaccttgccgatactcgacgtactcaatatgcctgggcaactcaatgaagaagagcctcctcccccagccaccatcccagctgccacaaactgaaacggatagaacaacgtctacggaagacatcccagggcagcccgacatagtgccatggcccatttcacgatcctctctagcttaggtgacagcagaatccctgtaagtcaattcttggccgatgcagagtctagaggcggcgtatttctttcttcaataagtcaacattcaatgtggtttacttttaaaaacatgctctcctccaacgaagcttatcctcaacctcgcttacgccgtgctgcgttggttaatccttgggttacaatttccacggcaaccccgccaacaagaatatcatgcagctaacccctttagttattgcttaatcaatcttatttgagaacgtcttgacattcttgttaggccagcgcctggatgcagggtctatgtgggcttcttccgttacatgataccattttgagttggtagagctgctcatacagtagggtatattcgtggatggaatacgactgaaggccctacactaagtggcaggtgagaaaaatattaaatattcttataatctatatatattttaatcttatatattatttctaagtagtaatatttaaattctttaaatatatatataatagttataaacttcttattatagatagagtaattaagttctatattatatagttttttttaagaagaatactataagatatagtactctattattatctctttagttaagttatatactaattataaaatctaaagtattagttttaagttctactttctttatagaattaaatatttataatatagattctaaaagtatttaattcttaattttattaaatactctttattatttatctttttattagaattctattctcttttttataatattatatagagatatagtaatttttctataatttttaataaattattaatagtagttaataaaactaagaaaagcttatactttcttaatagtttttaatactttctatttcttaactataataattttcctttattctatttatattttatttaattaaatagtatatcctaagaaattaacttcctatatatagaaataactcttttctaattctactaagaattttatattttctagtttttttaagatcttatatatatattctttatatatatctagattatctaaaaagattaaaatattattaagataaataattataaaaatattaagatacttctaaagtacttaattaattatttattagaatattataaatatatttattagtctaaagagtattataaagtatttatagagattaaactttattttaaatactattttctatttatctctttcttttacttatattaagttataagctccttttaaatctagtataatattttgaaaggtcaaggcctccagtatagggtagaccagctgtagggtaagctgggtctagggtaggtgcagcctatagggtaggctaaggaatactgaagggatcgtttcgaaaggcgtagtggaagaagcagcctacttagcaagaaagagaggctttatcagctacagggtagctaagaagatagactgtagggtagataaaagagtgaattggtggcttgaagaacctctagctggtcggtagtcctgcggcaattcaacgaagtatcttccgcggcggtgctctcacgagggtgactcgcagccgtctcttgctgaatctgcatctgcacgctctcatccgcctccaccccagaccgtgtgcgttttctcctcagtgtcccagccacagccttgaccgggccatacaaccatcgaaagtcatgcacgacagttgcaatgcccccaagatttagtataagttaaacaagaagacgagaacacagtcctccaacgggcggaaataccttgcagtattctggttgtggtggcggcgttgagcctgttggcggtcagcatgtagatgatgacacgagccatttatcttttgtcttgccctcaccccctcttacttcacttgctgttggcggccgttcctcttgttgtagtgtatatctctgcgcttgagcgagagcgatcaacacggctgtgatataagggtcctcccattccttgattggccggaggcgttggtccgctttttgccataactatacaatcaatcatctcacgcgaaagcgtctcatgccaaaatatctcatgctaaaacgtcttataccaaaacgtcttatactaaaacgtctcatgctaaatatctcatgccaaaagtcttatattaaaataccccatgctaaaaagttgtataatgaataaaaagtaccatattatactacttaaaatttaagactttctattacttagggcctccggaaaatgtgactttaaattatatatcgatagacccggtacagcgagactattaagcgaatgctgctactacttgtatatcaaccttacagattacgccagtatatctaccaatcttatactgccagacagagtactatttcccggaaatatcaaagtatactccgagtatgggatgtataatcttcatcagaaatactatttcacagttatctcgagaagtcggaaatagaaaagatcccaggagtcttctgcaaccgaacgctaaagctcctatcttcttaagaagtaatattttcaacttagagatcttttgttgaaaaaggatgtactatatattcttccgtcgcatactcaatacactaaatcagacacctacgaattagcagctgctatttgcagccgggaagctctcatacagtttgttcgcctggtggatgcatagaaactctttcagacgcccagaatgattccacagctagaagtaggtacaagtagccctgattccgttcgatcgcttttaacctgcctgatcgcaagctaaagggacggggaacttggcttatatcgtactcgagtgtatttccttcaacttatatccactcgaaccagacgatcgccagactaagttgatatagtctatgaaaatcctaagtagataagagctgattactattctgctcgagataaagccaaacgctagttgaatatatgcaatccctccagcagcgatatcccaggcaaggaaggattttatagtttgctactattcatactattgcaagcatttgaaccgttacaatcagagagagatacgtagggcgttaccaagcaggtatataagactgaacaaggacgccctcaaagatatgcatgatatccttaccttcacccaattaacgactcaacttaccgctaggcgagacttggagaatgctattgcaactggtacatgtgaatttgcctttgaggatacaaagcctaggccagactggaagactatccctcaggaagaagttgatggtttattatatgtggtccaagattaccaaggaaaatagatacaataatccgactaagtattttcctgccttgatttctatttactttattccttatcaatagtattctatcttctttaaagttttttccttaggccaggtataagagcgaattaaaacgtattgagctttgtcttataattatagtaatcatgatagtaatatacatggttccagacaggcttaatgctaggtctgtatatataaataccctgtgtacccgatagcgggggcatatatattgctggtagttctaatcgaaataggaatagtcagatttcattcgttaggcggagcgcctacatttgtgataagtcttgctaatcctttctctttaatatcactatctaatgcctatcctacctcccacccttagatatgctcaacagtttcggacatccgttttaaatttttaaaaacattcttctcctatgtatctagaggtgcacttacctaaaaatacgattggtgaaccaaatatagttcttctttcatcttcagcaacacccagccaattcctgccaagccaagtgagcatgacaagcagcctatgaccaggagtggaatgctgccaactggtctataccgtgtgctggatctgtgctatcgccactgagtctgtcgcagattgagccttcctcgacgaagagcacgatggacctagccaggtcactcagcatgataacaacagctatattctcggtaaaattggcggctactcctgctagatggagagtatggcactacctcggcggcggtggtagcacagggtcttattcacagctatctaaatgtgcgtatcgggctgatggtggcattgggggcggcgcacccagctcgaagcatgatatacgtctcggcgatgtcatcagcagcccccatggtggaaagggcggcatattccaggatgactttggtaagacgattcagaacgtcgcgttccaagaaacggggttcttggcccaacccccgatggtattgcggacggctgtgagctccctcaagagtacctacgagttacggggccaccatcttgcagacgaggtggaacgggccttgaaccgcatcaaaacgcgaaagaagtacgagcgacctgctccagcacgcgacaaattgtacaagccccacgctgtccactcgatagcagccgacagctgcgacgatacatgcgatgtagcttacctggtggcccgcgatgaccgagttgaggaagatgacgatcccgccatacactacggtctaatcgccagcggaaatcagttgatgaaagatgcacggattagggaaaagctggcaatggacaaagaagtcttctgccacgagatgaggcggccggctttatgaaccactttccgcgtctgataatcggcatatgcgactattccgactcgcacaaaaacaagagaggcaggggttctctgccatgatggcggtagcatacgagcgggaccttctgcggtagatcccgccgaacaaagtcgaggcggaaagaccgatttctgaggccctccatgctaggcagtttacgagtgttttgtattcgctctatctaactcggcgtagttgaacacaaaatcgacaggctgcagcagaccacagcggcaacgagcgttgaccgacgtaccgataagatcgagcgatggcttccccacnnnnnnccccgagatccgtccacaaacgtcaaccattcgaggaagcttcgccatgagggaacgggcgtgtggcttctggaacacccagtcttccaggattggtactcagggtcgcgtcgacatttatggctgcacgggcttgcgggatgtggcaagactgtccttagtgcaactgtgctgaatcatctcgcaaagggaagcggccgtcatcctcagcttcttcttcgactttggcgacgaggcaaagaaaactgtggacggcatgctgcggtcgcttgtcttccagctttatcgagcggagactgattctctatagcggcgcttgatgatattatacttagagtcgctgcttccaataaccgtctctctgctacggtaatggtttgagttccacctgtttgcctacgtgggattacattctcttttatcaacttgccaccatggaagccacggatattgaccaaataatggcttcgaaataacgtgacgtcattcgagcctgcacatcgtaaaccaaccgggtgtggggatcggccagtgaatagctgcacgccacgttgatgatgcggaatgggtgcaactgtagtctgacggctttgttcggttacctcctctgtctcctttttcattttcctttccttcttccaccttgcaatcacaattatgccagtgtcacctgagtacaacaaatcgggtcacgctagatggcgagtttatcatacgaaacaggatggaaagtcaaatcctcgtgggattgatacagaattccaaaacgagtctgatcgggcgccaaaccaaactcttttggagaatcaccgagaagaatcactttgtgggggtccagctacacctatgattaaagttccagatgaaagtatcagcctaatagaggaggacaattctcatcaatcggcagctcagtccagtagaatggaagggaacaatttagaatatacaaacggcagaactgaaaacaattcacttcccccgtacattgatgataacaaatcggatgatagtactctcgactatcaggaacccaatgatcaccaagctttctttgaacaggctgataaaaattcgctcaattcactatctcatgaccagccttatattcgccaagatatcccggcagtggtggggtctagttatgatttatttccaagcacgggagaggttagccacggaacaagtggccctataccgagctctaggttgcaaaatgaagaacaggtcttatcaaaacttgcttgtatgactcaccctccaaaagccttggagaatagcagtaaaatggatgatgagcatacagcaagtaatcaactagtgaaatataggcatcagttattatcagaggtactctctggtattcagcagagagggctagaccacgcaattctagatctagctaccatgaatattcgaccgaccttgctagaccttgcttacagcagcttagctacccctgccctccaagaggctgaagattatgaattgtgtgatgggattgtaatggacaatcaattggcgagtgaacaagatcattaagtatcactagagctagcctttactaaccaatattttgaagcatttaaaaacgctataacgtgatccaccaccatgtgggccataccaccatgtgggccactttccttaattttttatatcttcttcttctaattagtataactcaacaacctaatacaatgacactaagtgaagaacatcaaattactcttgctcttcaggccttacaatctacaaaaacattaagcatccggaaggctgctaaaatctacaatatcagccggacaacactaagccgtcgaaagaagggtagaagcgaccgagatacgtttgccatcaaaacacggaagcttacaatcttagaggaagacgttgttcttcagaggattcttgatctagattcccaaattttaatttctattaattctaatttaaatatttagaagagttttattactctatataattagtatactaattaattagtaggtttatatcttatagttatagtagctctaatataatattataatctcctagtagtactaagttatatataatattaaatttctttttttagattttaattataagataattagtctctaaattaataattctattattatatttaaattttaagttttttatattagttattatataagtttctttcttctttttctataataagtagaattagttaattactactagtaagatataattttcctatactctatagttaataaagattataagctagttccctttaatctttatttctataaagatataaatagagcttctagtttctattactcctaggattctttaatttattattaatattatattatactatagctctattataaatagtttagattattttttatctagttaacttattctttaaatatactatacttattattatattttaatatttattttaaaagttcttctaggattttagatatatttatataccctaggatatattattagaactttcttagttatctactaagtttattttattttttataaaatatagtttctttttaaaaatagtctatagtctattcttatttatttatagagataatttctaattctttattagatttcttatcttttattaataatactattatagtttatttttaatattagtattatatttctttctaagcttagtattatttaaatatttatctagtaaggtttttattataatttctatttcttactagattaaatactatttacttagtatataaatagtttagatagttctagttatagtattatttaatatactctctatagttataaatagtttaatctttttaggttttctatttatattataatttaattttcttattcttatagaccttatacttctattcctagtatattttagctaatatattataagctttatattccttagaatacttctctagatcttatttaaagataaagtattaattagtattaagtagtttatttataaagtataaagtttccttactagtatatctaaatagtatttctttatttagctatagaaaaatattatttctaatcttctattactaatagatagtataaaagatattataatatattaattataattctttatagtatttagttcttaaggcccttttctattctctaaatagcttatttaaactatttagatattaaatagtatctatagttctttatctatagattataagtatttctaatatagctagatcctatttcttaattttctactaatagtagatataaacttctttatattcctcttatattctattctttatataagtatcttatttttcttcttctaatatatacttagtaaacctattattatatctaaatactattttatatattataaatagattatattctatttcttagtttttcttatatttctttttaagattttaaaatattttcctaatctattattaattctttattattatattataattctaatttttagaattttctaatattttataaagggatagtatatatattatagaaaatttagaaattttaatattatttagaatttcttcctaagtagtttttctaattattttaaaagttttaatcttagtttttctaatagcttctaattattttttatttttcttaataggtttctagtttctctacttcttaggttttagatattaagataaaatatatctaatcttattatagttataatatttttatttctttatagcttttagctctataggatctatatatattctaaatattataaatagtagtaaagcttattatactctttagttagatttatagtttatcttaatatagttctaactattttattcttttcctttttattacttttatttaaaaagatagttattaatatatactatagtagctatatactctaataattcttctaatttattaagtttaaaaagttaattcttaatttctttctttagtttattataaaatatagttttaagagatatattattctagtttagataagatataatctctttaaatcttattatataatctaaaatagtttctatctatctaagctctttaaattcctttatagtttattatttatagtctatcttactaaatatagtagtaagagtaattataaagttattatagctaataagaatattaatagtttcttagttttatagtttagatttagttttattattatactagttataaagatatatctaaaactagtatcctatagttctagtaagatatattcctataaatctaaccctattcttattttctttaagctttattaggaagaatttaaagtatacttaaagctggattctaaatctattaagcttttaaatatctttagtaaaagattttaatagtaagggttagataatcttattttaatccttctataacttattctttttaaaactcttaacttaaagtataagttatttaataatctactaaatagtagatagctttatagtactattctactgagcaggagttcctaagatagttataatatcttctttattattatataataattaaaataaaataattagctgaataagagttattaatatataataattagaataatttatactaaatagaaatctaaagtagattaggattaaactaattagagtattattctaaatagtataattaggttattataaactatataatataaattactattaatatataaatattataaagctagtaataataaatatatagataattatattaataattactaagagagtatttctatctaaataaaataaatatatatatatactagatagcttatataggcttactagtaattcagagtaagtctaatcctagattatataagcttactagtaatctaaagtaatctattcttaattagtaataaaaagtagaatataatatataataccaggggtatttctttgtttataataagtagatagtagatctcttagataaggtaacccaggtactataagcagctgggtaatagggataatagaagagaattcctagttaactatatatataatagtatagtttttattaataaaaatattattagtacttaaattaaagtaatataaggggaaactagaagtataactatctaaatattcaggggggataagactttatataataatagtattaagtactattttagcagtataatagttaaaatagttcttattactatccagcttattacctataactataaaattatttaaacaatctatagcctacttatagctcttaaaattcttatactaaatacttagattagaatattcctagaagtactcctggatatagataatcttattagatattataagatagataccctgttctgaatactactgaatagtattaatattataatatataataaggggattaattaggcaggtaatagggatagggactataatggttagagggtagagactggtatattagatcctaaggtaatcttttaatctgtattatcagcccttactattaattactaggtattttataaaggagaataatataatagagcttctttaaaggatctgtataaagctttaggcctataaactatttatttaatactataataatttattctgatctaactaattaaattattaatatataacctgtaagataatctgttaagtaactaattaccctgcttttagaagattaaaaaaaagaaagatactctccctccttcctaaactacttaattcttttattaatagctaggagtataagataaaatatatacgagttactatactataaagatttatagctataggtattataaggaagaggatataaaggttaaattatactctaataagtctaaagtaagctactagataatatataagctacttactttatatagagagactaagaaatatagtaaatatagctataaaaatctataatataagtttaatacttatctctatatataaaagctaatattctagaagttatatatactgagacttgaccgagcttattgttgaaattacagtggccttcaaggtgtattgggccttgagaccgctataacgcagcagggaagttcgctataacttacagctctcaactgctaactccgctattactcagtgagttttagtgctagagggacctaatatagtgcaaaatatagcgcaaaagaatcttatttttgtgagagagaccagaaaattatactaatttctctcataggtctaccgactaaaaactactctaaaacccgctaaaactgcttcccgagctacttttgattttccgcaaaattcattactataggaaatctaaaaaatcaactcataaccaccaaaaccttcgaccaatatatatagcttttatgagacccacttttatctaaaagagactcttaagctgatcagttgagtatagatattgaatatcttatctttaaagctgaatataaatagatctttagctaattaaaagaatatataataaatataattagtaaataactatattagattatcttagataatagttattattactttaagaatcttattagaagtattaattagattctaagagattagaatatttatattaaatattataattataagtacttactaagtatctagtaattaattaattaaataattagtactttaagttaaaaagaaaaagtaattattattattaaataataaactttccctcttagaagctatagctatagttagattatttatatatctagctatataaataatttctattattagagtttttaagatattaatatctatattcagactaaaagtataatatttaactttatcttatagtattaaaggtttagatataaactaataattatattcttaaataatataatatagatatatagcgagctggacagtatagcgagctagatactctaccttggaaatagaactatctatttttaactatatatttctctactaataataataataaaaactgcagataaagaaagatagataatcttagcttgctaagctatatagaaaaccctaaagcttagtatccgagtagctataaaaatctatatagtaccttatagtatacttagtacctatattaagggaatacctactagatataatattatacctaattcttagaaacttataaatctagagaaattaataattattaactatatcctggatctaaatttataattattttctccctagcttagtagtatataagatatagtaaattaactgcctactgatattataaataaaggccacctctggggctgcaggaagttatatataaggtagcttagcagatctaccttacagactaataaggttaactttactttagtaaagtaaagtcttaagtaaagactattataaatactctagtaaatataccggtatatatatatatttatttctatagcttaaatactctttcagatagttattaatataattatctatatatctattattactagctttataatacttatatattaatagtaacttatattatatagcttataataacctgattatactactcagaataatactctaattagtttaatcctaacctaccctagacccctgtccagtgtaagttatctaaccgttatagtaatattatctctctaactaatataaagatagtatactactaaaggattagattatttctataacttataacagctggatattaaataaaaagagtatagaatagatctagtattttaaaaagtatactaagctacgaacttaaggtatatattatcttctaattataaatagatataaaagctactacttaatagaatttaagctattctataaggagtattagataattatactttatataccttcttatttatcttatattcttcagctacttaatattagctgttttaagctactaaagaagatctatagtaaagaaattaaaaagataattgttgaatttgagagattatagccactataagttagtggggtcagatcgctgttagcgatcctgaccactagctgctagcgatcgcagtcagtaactgctagcgatcgcaaccactagcttatagcggttgcaaccactagcctctagcgattgcagccactggccacaatcgctaataaccccctgccaacgctagccaatagcgattgagatcgctatccgatagcgattacgatcactaaccaatagcggctgcagccactgtgggtcagtggctacagcccgctatgactgctacggcttagcgggccctaggaaccctcaggggtccgggccaccagcagagctattattaggttatcgggcttatcttaaaatacttatagaaattaaactttattctaaatactattttctatttattttcttctttaatttatattaagttataaatttcttttagatttaatactataaattactattttttttataattagtctctaagttctataattagtagtaagagtattctatttttatatataatcttatttagctattaatagttaataactaaatagagtttattattctttttagtataaatattataaggtattctatagataaagttaataattatatatagttttttattaatatattattaatatatttatagagtatttatagttagagttctataagattataaagtttttaaaaagctagttcttcttttttaataatagagattttataatcctattaattatatttagatagactagttttaagggttttcttaaatagtttattataaattctattttttctaagatattctttagttattcttcttcttttaaatatcttatctatatatatttatactagatattactttccttattctattatactttctattagttatttatttagttctattcttagattctaatattaaatagttttagaaatagtttttttatttctttttattattagttatatttaactttatattcttattattatttttttattagctatttctaattaattagtactaagaatatatctaagagctatacttatttctatatctaatctaagatctatattatttatcttagttcttattataataagtttcttatagttccagattataatactattaaaactataactactatatctatttattattataagttattttttaggttttttataatagtacttttagatattaaaaaatatatatatttttctagtatctaataaaatttttatttttattaattctaatttaaatacttaaaagggttctattattctatatagttagtatactaattaattagtaggtttatattttatagctatagtagctctaatataatattatagccttctagtagtactaaattataaataatattaaatttctttccttagattttaattataagataattagtctctaagttaataattctattattatatttaaattttaaaccttctatattagctactatataggtttttttcttctttttctatagtaagtagagttagttaattactactagtaagatataattttcctatactctatagttaataaatactataagctagtttcttttaatctctatttctataagaatatatttagagctttctacttctattatttctagggttttctaatctattattaatattatattatactatagttttattataaatagtttagattattttttatctaattaatttattctttaaatatattatacttattattatattttaatatttattttaaaagtttttctagggttttaaatatatttatatattctaggatatattattagaactttcttagctatttattaagtttattttatttcttagaagatatagtttttccttaagagtagtttatagtttattcttatttatctatagagataatttctagttctttattagatttcttatttttaattaataatattattatagcttattcttaatattaatattatatttctttctaaacttaatattatttaaatatctatttagtaagatttttattatttttcttatttcttactagattaaatactatttatttagtatataaatagtttaaatagttctagttataatactatttaatataccccttatagttataagtagtttagtcttcttagattttctatttatactatagtttaattttcttattcttataaatcttatactactattcttaatatattttagctagtatattattagctttatatttcttaggatatttttccagattttacttaaagataaaatattaattaatattagatagtttatttataaagtatagtatttctttactagtatatctagatagtatatttctatatagctatagaaagatattattcctaactttttattactaatagataatatagaaaatattataatatattaattataagtttttatagtatttagttcttaaggctttcttctaatctctaagtagcttattaaagctatttagatattagatagtatctataattctctatctatagattataagtacttctaatatagctagatcttatttcttaattttttactagtagtaggtataaactttcttatattctttttatattatattctttatatatatatattatttttcttcttttaatatatacttagtaaacttattattatatctaaatactatcttatatattataagcagattatattctaatttttagtttattttatatctagttttaaggttttaaaatattttcttaatttattactaattccttattattatactatagttctagttcttagaatcttctagtattttataaagagataatatatatattttagaaaatttagaaatcttaatattatctagagttcttttctaaataatttttctaagagttttaattttaattacttctaactattttttattttccctagtagatttctaatttctctattttttagattttaaatattaagataatatatatctaaccttattatagttatagtatttatatttttctatagctcttagctctataagatctatatatatcctagatactataaatagtagtaagatttattatactccctagttagatttatagtttatcttaatatagttctaattactttattctttttctttttattactttgacttaaaaagatagttattaatatatactataataattatatattctaataattctagtttattaaatttaaaaagttaatttttaatttcttcttttagtttattataaaatatagctttaaagagtatattattctaatctagataaaatataatctctctaaatcttactatataatctaaaattacctctatctatttaagctctttaagttcctttatagcttattatttataatctactttactaaatataataataagggtaattataaagttattataactagtaagaatattaataatcttctgattttataatttagatttagttttattattatactagttataaaaatatatctaaaactaatattctatagttctagtaagatatattcctataaacctaattttattctttttttccttaaactttattagaaagaacttaaagtatacttaaagttagattctaaatttattaagctcttaaatattcctagtaaagggttctaatagtattagttaaataatcttattctaattcttctataacttattcttcttcttaaagctcttaatttatagtataagttatttaataatctattaagcagtaggtagctttatagtattattctactaagtagggattcctaagataattataatatcttctttattattatatagtaattaaaataaggtaattagctaaataagagttattaatatataatagttagataacttatactgaatagaatctagagtagattagaattaaactaattagagtattattctaagtagtataattagattattataagctatataatataagttattattaatatataagtattatagagctagtaataataaatatatagataattatattaataactatttaagagagtattctatttaataaaataaatatatatatataggaaggtaatatattagatatagaatatattactattagtattatatagatatacttaatatatagaagattaagtatatcagcctgctttgtataacttatagtaataatatagagagagtagttttataatattaaagattagatctatttctatactcttactagctataagatagagtaatagttctagtagatataattactaagcctatatataaaagagtagctttattattataaataaatctataatagagtatagatttaaataattaatatttaaaaagagattctaatagttattactaataactattattatatatataaggacctagtaacttataataactagactctatagggaataattatattagagatatctattattactattattataagagatagtaggtaatattaagcttagagagatattataattaattataaataataagtatttccctttagagcctatagttaagttatatacttaataagctcttcttagagtttttagagttactattatttataccttagctagctatataataaaaagtaaaaaaaaaatagaattaaagattagatataaactagaacttagttaaaaactaattatatagattatattatatatagtctgatcttagaatattaccctttatatatagtaaaaacctctaaagatattatctattagtactatatatagtactttaaattataataattattaaatactaaagaaatattattataattctctataaatatattattaaagattagatctatttttattttttttaagggtttttactatatataaggggtaatattctaagatcaggctatatataatataatctatataattagtttttaactaagttctagtctatatctaatctttaactctattttttttttactttttattatatagctagctaaggtataaataataataattctaaaaactctaataaaagcttattaagtatataacttaactataagctctaaaggagaatacttattatctataattaactataatatctctttaagcttattattactaactatctctccttataacttattactaactatcttttataatagtaataatagatatttctaatataattatcccctatagttagagcctgattattataagtaactaagtctttatatatataatagtagttattagtaataactactaggatctctttttagatattaattatttaagtctatactctattataaacttacttatagtaataaagctactctcttatatatagacctagtagttatatctattagaactattactttatctagtagctaattaatataaagatatatagataaacctaatacttaatatacttataaaaaactataataatattcctctagtacttaataattattataatctaatatattatatatagtattaataggtaatatactagtttaaattaatctagattaaagtagctctttaagttaaataaatatctattttaattagtattattaaatagaagagaattaaatagaatagaattattagaaagtttattaaatagaaaagttaaattaaataaagttaatttaatagtatctagtattataatagattagttagttattattatagaatttttaagagaagagtaatagctaattataaagttactatatattaattctaaaactaaatcttatattatataaggagatttatctctatatttttactagttataagatagaataataattttagtaaatataattactaaatctatatataagagaataactttattattataaataaatctataataaattataagtttaaataattaatatttaaaaaaagattttaataattattactaataactattattatatatataaaaatctagttatttataataactaaattctaattataaagaataattatattagaggtatttattattactattataaaagatagtaataagttataaaaagagataattaataataataagcttaaagtgatattataattattattatttattctaaatactagatctagctagtctctagtctctctatctaatctttaataagggaaaaccttatatatagaataaaaatcttattctatttattttccttataattctaattagatactaatataacttctagctctctactttctattatttatttattttatttctattttagttcttatttattaattagtattaatagagtagtttttaatttatattctatataaatataatttaactctattttagaattaagattttaaaattaattctagcttattagtttaaagaataattactctattatctaattagctagctttagtttctatttttctaatttttaattttctttttataaaatataatattatatagtataaataactatatataaatagatattagattaatattaaatctatattattcctaataaaaaccttctatagtagtaaatatatattatatttatagagataaattaactaataaccttatataactaacttttcttattcctaaataagtataattttaaattaaattaaaataaaatctaatatattaatactaaacttaatcaataaaactaataccctaatctaaatataattaaaaataatataaagcttaaataattaattttaagagctatttttactctaattaacttaatatagtatataatatattaaaataataaattatatattagattatagtaagcctatataagtagatagctattcttaagatataacttttcttctagctagtctctatcttctataagtatctatagtagtactaaatagactatataataaagtaatagattaagtagatatagctactagatctataatattaaaagtagctttattactataaatagatctttaactaactgaaggagtatataataaatatagaaaagtaattattattaatagataataaagcttccccccttaggggttataactatagctggattatatatatctagctatataaatagctcctattattagagtttttaagatattaatatttatatctagactaaaagtatatttatttaatctttattctatagaagatctgaatatagactactaactatatatataaaaaaaactctatataatagataaattatatattatacctgatcttaggataactttatttatagctaaaaaaaaaataaaaaaaatagatttaatataattttaatattataataaattaaaagaaaaatatataaaaaattctaaaataaattttaaattttaaaattctaaaataatataaatttatagaaaaactaaatatattaaataaaaaatttagaaattctaaatataatctaatttagatctagataaatactatattaaataatatttaaactttaataaattaaaataaaaaagaaattactaattataattaaataaatataataggaataaaatagtaaaaagaatagaataataatattaaaaatataaaattaaaactctaaattataaaactaattagaatttaaaataaatctaaaataaaaactaatttaaagctttttaaatatattaatattttaattagtttagttctaatttagaatatactttttaaacttattaatattatcttttttaattttacttttattaaactttttatttagagagagtatttttataaaagtattaagaatattttaaactaaagctaatatagatatagctatttagattagaaaaatatatatagaagagtattctaaataataatattctaattaagaatatttaattaaatattaaatctagttattaattagtaagtttttttatctttagtttttaaaataataataataatctagttattatatagaacttaaccctatataatataaaatttagttttagaattagtatatagtaactttataattagctattatttttctcttaaagattctataataataactaactaatctactataataccagatactattaaattaactttatttaatttaacttttctatctaataaactttctaataattctattctatttaattctcttctacttaataatactaattaaaataaatatttatttaatttaaaaagctattttaatttaaattaacttaagctagtatattacttattagtactatatatagtaccttaaattataataattattaaatactaaagaaatatttattataattctctataagtatattattaaagattagatttatctctatacccttactaactataaaatagagtaataatcctagtaggtataactactaggtctatatataagagaatagttttattattataaataagtttataataaagtataagcttaaataattaatatctaaaaaaagattctaatagttattattaataattattattatatatataagaacttagttatttataataattagattctaattatagaagataattatattaaagatatttattattattattataaaagatagttagtaataagttataaggagagatagttagtaataataagcttagagagatattataattaattataaataataagtattcctatttagagtttatagttaaattatatacttaataagctttttttaaagtttttagaattattattatttatatcttagctaattatataataaaaagtaaaaaaaaatagaattaaagattagatatagattaaaacttagttaaaaactatatatagcctgatcttagaatattaccccttatatatagtaaaaacccttaaaaaaattaactctttagtatttagtatattttccttatagatttttatatcttttctttatttataaatatctttttttttctaatttttttttatataattaattaaataaataaattctttttttcttctatattaattttaatataaataaaatttaaaataaatcttattctatattatatttatgctttctttatttttttttctaatttattttactttctactttttattactatataaatttaatttatttttattttctctattttatctctaatttaatctctagttaattctagttttagttcttattattctagaactaattttacaaattagagacaatggatggaacggcagtccgcggcacctttgcgcccgaccgtttgaaggagttccaacaagatgacgagggttggtggagaagtgacgatgactcccacttagtggaggcagagccagaagaggacgacactgatgctctcgcaagccaccaaatccctgaccaacttgggcctgatgaagaaaagcttttggcagacgatgatgcaccatttgatcaaatggttcataaacctgaaagtgatgatgagccccaaatggtgacaaggtcgcagaaaagggtcacgttgatacggcccgctagtcctgacggaagcgacggatctccgaccttggacgagatcgtcgtccagatggattaagagagtcggcctatttcgcatgcgataaagcctaggttctcgccttctcttcacgaggttaacaagaaggctcgggggagctaggagacgactttatcttgcgcgcacgacacaccaaagatcacgtacgcgacactgagaaagccagccgaggcaaaataaaacagcacgaagaagcggcaaaatgaaaatcttgatatctgctattgcgaaactacttgatcaaatggttccgaccgtgatggatcaatttaattaaaatcccgcaacgaaaagcctgataatcaacctaaaaccgtggaaagcccgtccgggctaagatcaccccacacccatgactaaggaattacatctccgtgttgacccaagtgctgaaccaagcaatatcctcctcagttggcgggtcgtcgctagtgggctcggggggccaacgtcgacagagacggggggctgtctcaggggaaagaacctcttcagtacggataggagattcgactgtattatgaccgtgaagagggttaggacctcactatcagaccacctcgtctcactaattaaccacccaattgtggctgagcggggctcggtagccgatatcgcaaaggagcctatttttacaccaataacagcccctttttgcagggatcgttaccagctgttgctcaccaccacacccccaacgcgtcacaaggccgcattattgacaacgcgataactctgccaaaagtgaagcttttcgtgatatcttttcactaatggatagcctattgaaggaggttttccccactgccgaggctgcaaaggctgcgtgcgacaaatacagcaaggaggccggctttgccctcatcatccgcaacaccaagagggatgaagaaggaggcataaagtgcagactgctaagctgctgcaaggcaagggcatatcgaagtcaacacgatccgaatactcatccatcgaaacgccgtcgttcgaatacgcaaaagtcatcctgtcctttcaagttgtggatcaaggctacgggtcaagacaacttcgttatccaacgcagcagcaacaacacacataaccacgagttcgaagatccgacatccttctcagccttccgtaacgagacgatttcgcgattcgaagaccagataatctcgatgcataagtcgggttcatcgccgcttcaaataactgtctggattgatcagcaagtcgaaaaagcgaaggcagccggccaagctgtgactgacgtcttccctcgagatatttccaacctgttagcacagtatcgccaaagacgactcaacggcctctcacctctcgagtatctctacaaccgcattaataaggacggattcgtctttcgcgaccgctgtaaccctcagggccagctgacatctcttctgatcgccccggaagccgggctcgagttattgaagctacatccggatgtgctcctcctcgactgcacatataaaacgaatcgatttaatatgccgcttctgaacatatgtggtgtaacgggcacaaacaagaccttcacagtggcttcggtcttcctgaacaacgaagttgaaggcacctacaagtgggctatctcggcgctgttgaatatcatggattcgtatgatatccctatgcctcgtgtcacggttacggatcgcgagctcgccctaattaacgggattgaaggggaacctcgtcttgccggatctgtcaaccttctctgccgttggcatattaatatgaatatccttgcgaaatgtaaaaggatgtttccagccgcgaagagagtcaacggccgcgttgaacgggatccttcctttcagtccttccttcacgattggggtcgcctagctagatcgcgagacgagaaaaccttcaacacacggctgacgaatttcattcgggatcaccctaagcaaccggttgactatgccctcaatacgtggctttatccttggaaggataggtttgtaacctatctcgttaacctccatcgtcacttcggccatatcacgacttcaatcgtggagtcactccacggtcagatgaagcgcttcctttggtcttcgaagggtgacttcgataccctcatagatcggtttaacgacttctggaaacgccaaataaagaatattcggaatcttcagtcaattcagcgtcataaaatatcaaccttttcaatcaagccgatttatctgccaattcgtgagcaagtgacagcaagggcgttggcgatcattgaaaatgaacatcgggcagtggagttcaagccgcttcgcaatagcctcttcgtctcgcaaggctgcatttgtgagaaggctgttgcttgggggcttccatgccgacatattattcaatcgcggctcttcaataatcacactttgaccttggatgactttgacgatcattggatttggaagtcctatcgaacggagcggacagtgcccttcgagcccgtcacagttaaagggaaaggaagacctcgcggctccctcaacctcgataaaacacgaagcactcgtcgcgatccctcgtcatacgaagtagccgttgcagccgaatctcttgagtcccggttgccgccgccgccgtcaaccgctccggccaacctcgagacaccacgtgtgaccgggcttcaatacatacggcaatttggtgataccctcgaacccggaacagaggctcctcgaagggctcaagcagcccgctgctgtacgcctcctgacgagcctctcgctgtaacgaacaaagccggacctatcgtcgagtcacagtcacaagatgctgagggtaagagcctcacggatatagataggttgttattggcacgtcaagatgagatttgggctgaagaggaagaggaggattcaacagacgattgggatgatatttatcagcagcaggagacgcaggaggagatcacgtgcgacctatcagacccgaaattcctcccccaatgaacagcagaaaaaacaccacatttgaatacaaatagccctaatagccctaacgcgatagcctcgttgcaagacctgcttgtcttgctgttgtgatgtgtgtgttgtggtgttagaattccccctggtaataacccctgccgaaaagtgccgttattggtgtgaaaatcggctcccttgcgatatcggctaccgcgccacatttgggtggccaaatagtgaaacgaggtggtctgatagtgaggtccttttcttatggcgaacatggtgtggggctacggatataagcctcgagcaatgaggtcccttgttgccaagacgaaaagaaccactgggccagaaaggacgaactgggtgatgatcagaaataatgggttaggtactcagagagtttacaagagatttttagaggattacgaagatacacgattaactcggaggagagtttcactgtagataaggtatatcaacatgcggtttggtttcggacgccaattagtacagatggaggcttattgccctactatctaccttgaaagaggctatacacaatgatccaactaaaactctacctctttatagtagtcgggagactaccaaaaagagcaatatagggtttcctaatctgcttgacattagggcttaagatcccctaatatacatatttgcagaggcaggaactaagttaagtaaatcagttaaacacaaaagtggccatctattcgcctcgacattctcttaacttctcatcccccattatcaagtcatcaactcaacaacgcttggacctgcgaaatatttccatatttttcaagatgcaagttgatattccatccgttcttctgctcccacttcaagtacgcttctcctaattagtgatatttcgaagattccccgcatgtaaatcagccattgaccttgagtcgagatatacccatcatttttgtgccttaagtgtgggagagaggacagtggctgatgtgatgacgcagaatacaatgccctcgccaaagcggtcccgcccctggaacctagttttccagagtgtgtttttctagttcttttttaatatcactgaattatatcaagatgccattcgatttgttcaagacgagggttatcatagtagtttagcattgggagacgcaaagaatgccgacctttagaggtgctgtatcacatatcaggtaaacaaccctagggtaaggcactaggatcaaatcgggagaaagtgacgaaggcgagggagagaagttgggaacccgtcttctcacgagccagacttgtggccaagaaccaagcgctaccctacatcatatcgcgtagagcatgtcttgctcccaggtgaaggaatgtctatgtttggggctcttggaaccagatcagatgagattaaagatatattcccggtcccagaattgtttgttagttagtttaatgtcactgaatgtgaaaatgtgacgtatggggattgttagggagagtcaatcgcctcgtcgccacattatagctgctggtaggtcactgatccgatcggccagcattctcatggtcattgagcccacccatggccaaatactgttcaaaatgagatcgtttgctcttctctaggtcttatctttatttaataaagttgaaaaaagctcctatcggcacagggcaaaagttgatttgtcgtaggaagagagcatcagggtcatgatagccttcaagcttggctggggagttagtggcccacaaggtgctggcttttagcggctgattcagcatttccgggggccggggggagccttttcaggcggctgtcgccgataccgacccgtccttgccgcctccgcggagatgcagtgcaaaccaccaggtcttatcttcaaaacatccaggatatctgggatatgggatcaatatctcgtctgtttggtcagagccgtcgattccatgagtaattgagataacagacaccacgccacggctcaatctattgcctcgtcgacgaaggaagatggcatgtggcgggcgctgaagctcagcagtctccacccatcgccgaaccatccaacaatcagccgcttcatccatccatcaccggcgatgaattgactttcccgattcatctccctgcctttgctgccccagtctgactttcccctcaccggtgccacaccaaagcaagaaagggctgcatgaagtcggcttatcatcgcagcgtccccgcatcctcgcataccggaaaggcctcagaagcagggttcgcgggaagtgacagtcgtgatggaaagaacagtttgacgacgaggaaatgcattcaaagcgtcgtgtcctttatgtccttggccggagactgggccatcgctccaagggcgtccagctaaaattcaaggtcgcataaaagcgtaaaatatctctcgtgtgatggctcatgatccgtcaaaagttcgaccaaccttggcgcccggcccatccatccatccattcaccacatctgcagctctctctccacttggtatcccattcggatagctccattgatagagagctctgttcgggccgtctgcagcttcagtagccacactatttattgcctgtcccctccctcttccaggcagttatctgatctgatcttctctcctcaatcttcctcgggaggagctcaattatcggctgtacgttgtatgatactaataatctacccataaaatcataaccatgcatcgctctgctctcctcgccctcggcctggtcgccgggcaagctgtcgccgagactgttcacggcgtggtcgtcttctcccgtcatggcgatcgtaagcaacctcaaccatctgtcgatcatgcagtgactaagtgatggcctctaggtacctccaagcactactctgggtacggattgacgtccctcggtgcttcacaaaacttccaggtcggcagcgactatcgtgctcgctacctggaggctgggtctgagcatcagatcctgggcatctcgcctgatgaatacaagccctcgcagatctttgccagtgctcccaccagcggcatcctctccaacacggccacggccttcctccagggcctgtaccctcccctggccggcatcaaccaggagctctccatcagcaagctgaacaacggcagcgacagcaccgcgcccctcgagggctaccagtacgtgctcctcaccagcatcggcgccgagtcgccagacaccatctggatcaagggcggcgtcggctgcccgtcctacaccaacgcctccaagtcgttcaaggacagcgccgacttcaaggcgcgctcgacggccaccaaggacttctacgccggcttctacgacaccctgtcacctggcgtcgccgacctcaagcccgagaacatgacgtacaagaacgcctacgacatcttcgacctggccaacacggcccgcatccacaactcgtcctcggcggcgcgcaacatctccgacgcagacatgttccagctgcgcacgctcgctgactcggccgagttcggcaccaattacaacgcctcccagcccgcgcgctccatcggcgcccagacgctctccggcggtgtgctcgcccagctcaaccagactgtcgccaccaagggcaagctcaagttctccctcttcgcggggagctacgacaccttcctatcattcttcggaatcacgggcctgacctctctttctactgactttgagggcctgcccgactacgcgtccaccatggtgttcgagctcttcaccgacgccacgacggacaagttcccggataatgtcgcggacctcaaggtcaggtggatgctgcgcaacggtaccgcggggacgctgaccgcctaccctctctttgggcagaaggaggaggcgctcccctacacgcagttccgcagcgagatggacaagcgggccatctctgatgtcaagacgtggtgcaacacctgctcatcccaggaggagttctgcgccgcgtacaagacgagcgacgacgacgccacggtccagaccaacagcggctccaagggcggcatgtccaacgctgtggctggtgtgattggcgccatggtcacgctcggcgttgtggctattgtcggtgcgattgcgtttgtgctgctgaggaagaggagggcgcaggcgggcgcagtggccagtgaggatatggagaagaagcggagtcttgacagcaggaccccgtcggcgtaatcataatttaggtagtgtgtgaatccttgaaaatgacagtgggaaggatggatgcgtgggatttgtatgtaatgattccatatgactttaatgacagtttgtgaaccgacagaggccttgtttcattcaatggctgtaaatcctagcttagtccatgatccatcatgtgaattgtctcggctcggtaatcaatatccaatctgcctgcaaggaatgaggagagtgtggtggctgcatgtagtaatagcgtaacattccaaaatcctggggtaaatgtggtctgcctcggttgatcgctcatccccgatgatgatggggcacgatctgcgtagtgtgtgtatatattcacatcatggccattcattagcctttaatgagagattagatttccattacgcggtatcacttattgaattgtctggaaagaaccagagagcaagatgccacgcccgatccgcattgccaactgctcaggcgccctcagtaagttcttacgcgatggtggtcactgacaattgccgtaatgttaactcttcctaacagctgaccctggggttcacatgtacaaccaggctaggtatgggcaggtagatgtaataacgggggactatctagccggtaagttggtcagcgactctccggtgcccacgatgctgagacagaagttcagaggcaaacttggcggagagcaccctgaaaaacgcgccgcatgcatgggtcaatacagcctatgaggggatcaaaatgtcgctggacgtcatcaatgagaaaaggatcaaagtaatcgtcaatggcggtgccctggatccaaagggtctcgcagaggaaataaacaagctcgtgagtgagcctcgcctcaagaatgagcgctctgctaacaataaatcaaaatacaaggtgaaagagaaacgcctacatctcacgatagcctacgtccagggcgacgatctcatgcacaaagttcatacacttcttaagcctccatcctcgtcttcatcatccttagacaaagacagctcacctgccctccatcacttggaccacgacaatccatccgtcactctcgaccactccgccctctcgttcctccaacatccagacaccatgcccattgtctccgcaaacgcctatctcggctaccgggccatcaaacatgggctcgatcaaggcgccgacatcatcatctgcggccgtgttgccgacgcctcccccgtcatcgccgccgccgcatggtggcatgcttgggatccaaccgactacgaccgcctcgccaccgcgttggtaggcggccatctgatcgagtgctctacatacgtcacaggcggcaacttctccggcgcgtataggtaccctgccgagacgtttgtcaatctaggcctcccgattgtggaggttgccggagacggggtgtgtgtggtgaccaagaccgaggggaccggggggcttgtgacggcggatacggtcaagtgccagttcctgtatgagctgcagggagatgtatacctgaacagcgatgtcaaggcggacgtgtcgggtgtcaaggtgaaggaggtggcaaaggaccgcgtgcgtgttgagggggtgaggggattcccgccgccgcccacgaccaagcttgccgtcttctaccggggtgggtaccagaacgagcttcttctgaatgcatccgggtatgcgacatcacacaagtgggatgtccaagagctgcaggtgagagagaagctgagggagtggcaggtgctggacaagctggacgtgctcgacttccagagagtgggcgtgccgatggaaaacccagacagccagttggcgtcaacgacgtacatgcgcatctttgcacagtccagagataagagggtggtttccatggttgctgccgcgtggaatttcacattcatgacgcattttgctggtgagtacgccgtgagtggtgtgtcgggttggataaaactgacaacgttgaaggcatgcacggctcgctggattggcgcactgcagctccgaagccattcttagcatattacccagccatcgtaccacaaactgagattgaggaatctatctccatcatccaaccgggagggatagacaaaagcgttgtcggccctcccgttgtcacagagccactccaagccagggcaaactacgagactgctcagccattgccgctagactcgttcggcccaaccatctcacgccctctaggtgacatcgccctgggaagatcaggcgacaagggagcaaacgtgaatctcggtctgttcgtcgagaagcccgagcagtgggactggctgcggtccttcatgacccgtcagaggctgaagcagatgatggggcgcgactggagggatcggtatttcatcgagcgcgtggagatgccaaacatccacgccgtccactttgttatttacgggcctctcgggaggggtgtgagcagctcaaagctccttgattgcctggggaaggggtttgcagagtacatcagggcgattcatgtccccataccgaccaagtttcttccacgggctgagcaggcgaagctgtgaatcactgaccaaatatacattgttaccacctgctttagttcctagcgtgagattttacaactgatcccagaggtaacggcctgttaagtggtcaattgtttgcttattgattaaattatttactccacgtaccggaagttttgccctttgttgctccattcacttgcctcccactcatcagttactttcctagcctttctgcaacattttcttggccttatattaagagtgccagctcttctagttcttccactcttttttctactacatcttccaactgcagacattcatttctcaaccactgtcaagaccgtcccattcaatcaaggctttcatcttgcatctctcacacaacatcctgtaggccagccaatacccaaaggtatagatcaaaaactggctgactctctacagaccaaagcacaagaaatgcctcccaagcccgaggaaatatgctcggccaaagacacaaatccagagggcctcaacgtccgcttctggggaacccagtccccctgcaccaaggtccacgccgcccccgacacctcccagtccgtcatggacctcgtctactggctccgtctcggccgcgacaccaaggcccgtccatgcagtcagtggctcgaccccaagggctctgaccagccagtccacgcacattggccctacttcctcgggagaatcggatgcaccgaggaggagctgaagcgagacgagtacgccatcaagtttccgggcgttcccgagccggtgcccatcgcttcggaggtgcagcttgacaacatccttcggtctctgaccaagtacctgcgctcgacgcctacgtactggtgccaggctccgccgcctgtgctgttgatctgcaggcctgagcaggtcgctcgatgtgagagcagaggctgggttgattgcgtctggcgcgaggcggccattttctacagagctgctgccggagttcgccgtccgtggatggaggaggaagataaggcgaaggttgaggagtcttttgaggcaactgggagcgggaactcggccactactatggggtataaaggagtgatcctttttgagggcgatgggcagacgcgggtatacgactacgctaaggatctgagtgctgtctgggtgccagactttgagccccctttctcctaggactagaggatatgtcaagttctctgcctgttgaattgtatcagtgcttcgggttcctggggcggaagggttgtagaagtgagcaaagatgcgtccttttctcagaacgagccacccgtcgccatcgagtcgtccatcaaagagctgagtatgtcatcttctttggtcccagcacttattccaataaaaacgcaattgcatcaagaaatcatgagtctttgtttgagcagtcaagggctgttgcttaattaaaacaatcgatgaataacacggcgagatggcagacctcacacattgagccaaggttactaactttatggccaattaccaataagtttcctatggcataatctttacaatatttcttgcttggtagatccaggggcgtttcatctcaagatcgttttgcgacgcaatttaacccccatggacgaagatgagacgagtaaagccgccaaacacaagccaacagccactcatctgccccctccgcgactccgtgtagatcacaatcaacaagcatgaatgcgatgtaactgggtgcgctgacctctttcagcgacatgccatgcacagcaatgtctcttttcgcgcgcggcacctgtagctccttgattctcacgtccaggttcgtgctgcaatacgaggtgcattctgattccagcagtgagcccgagcaacatcatttccagcatcccggccttgctcaataatttagtaaaccaaatggcaggtcgcttccccgcattcagagtcttgtgcgctgcgatgcaacttaaacccatgccgttcccctccccgatcgtctccccccccttgctggaagacgtcagtcgcccgccctgccagccatcaccgtaacacttggccccttctacgctttaaagttccaaataaggcagctcccgggggttcggtccctgtgcatgctgctttgtcccgaggcagaatggcattctccaggccagaaaccttcattgtcatgagcctggtgctacccaatttgacacgcccaatggtcaatcaccagctggggtaggatcgctctgctcgttatacctgcccagccctgtccaccagggggggcacgttgcatgaaagagctatgaggtagcacccagtgcctcagtttggccgtgtcactggaccggatcaaccaagacgatgcccaggaccaggaccagcagttactcttataaggaacggttctccaggcggtatatcccttggcccaggccatctctggcagaatatacccggcctacctaaaccaaaggaaaccatgaaggccctccatctcatccaatccctcgtgttagcctaccgcgccacggccttcgtcttcaacacgtttgacggcgtgggctcgcccgcgtgctacaacgtgaccgaggtgcacaacgccacgagcgtcgaggagatacagaccctcgtgcgcgatgccaaggggagggggctgcaggtccgcgccggggccaagggccaccactggtatgacacgcagtgctcggacgatgagacggtcatcatccgcaccgagttcgtgaacaatatctgggactttgaccttgacgctgggtcggtgatgatcgaggcgggggttacgttcttccagttagaaagccctgttgagaatgggactaagattcgttgggctgactgtcgcgtaggctcgccgagtatctccatgagcgaggcgcaaacattggtaccggtctcgtcaattggaatattagcatcgggggatgcgtggcggtacatgattcctcctctgacaattcgcttggctctcgctaatacttgaacctttccagatgggagcccaccgcacctcgttgagagaagatgcagtagtcgtcggaggtgtccaggagctggacattatcgatgggtcgggagaaatccgacacattgtgaaggacgagtctaatgacgagtggctggcagcatccacgtccctgggactgttgggcatcattgttcgcctcaagctctccatctaccctgagaccaagatcaaggctatgcaagagacgtaggtatcccaacatctcgctagaagaatccccattctaacagagatgagaacaggctggaagagaacgaggtcttgaacggcgacattgccggcttgatctctccatgggagaccgcaaatctctgggtacgtacatccaacacacagtcttaatcccacccacaggaacataagattctgacagcccgagtaaagtggtggccatacaagaagaagttccactggcgctattacgaaaccgtccccgaatctgagtccgcccaggagggcttccagtccaccttctccgttacggacgccgaggcggccgtggcccagttcctcctcgacagcggcaagtacacgcccacctccaactggctcatggaggagatcttcttcgggcagtggtccagccccaacttccacgacaagaacaccgacgccgccatcaccgagtggcccgtctacggctggaactacgacgtcctcatcggcggcctctaccccaaccagcaccctgtgtgggagcgcgggctgaaggggtacaccctcgagctggcgttccccgtgacgcgggcgggcgagatgctgaagcgcgtgagggagctgtgggatgcggaggcgaggaagctcaagatcatgagcgcgacgtaccggagcggcatcaacatcaagttcgccaaggcgcacaaggactttctggggcaggtcacgacggggacggccgacggggaggactggagccagggggccatcatgtttgatttcccctcgtatcggccgaccgttggggaccagaagcggtacaacgaggagttctgtacgtgtcactttgcccttttttcacttttgggttcgtgtggtgggcatcgggctgactgttgcagatatcaacctggctaatactttggtggacgagttcccctgccggccacactggacgaagaacacccgcgatgtgctgacaagagcaaagaagaacctagatcccgatgtaagtgggaggcagaatatctcatgcgctcgcttcagagtactaacgtgccacagtacctctcgcgcttcaacgccgtgcgcaaggactttgatccggatggactgtaccgcagcgtagtgggtgaaatactcggtttctatgattaagagggttcaatgtttttggtcagacaagttgcatgccaagtagtgttatctgcccatgaatgaaatatggctcaaccttgttgaaagaaagaaataacaagcaaacaacaaacaagaagaaaacgataacgggcgctgccctctgaatgtacacgtatctcgagatcctgttcatacccctccgaagggtggtgccacacggacacttatgtaacctcatgccccagtactaataatgaaaaccctcgcaacaacaataaaacctttcaacgccatgctgctaaacctcaactccaaatcccatcgaccaaatccgcccagttgctgccccatctaccttttgcgcccatctactttttgcgcctagctggtgccttggtcttggtgactcttgactgaggcgtcttcgttgccggggcctttgctttggaagtcttggccttggtggtctttgccttggtggtcttggtggcgttggcctttgtagccctgcccttggcagtctttggctcgggtgcctttttgatgcccttccagtactgagcaacaacttcaggcgctgtttcctcgacaacattgctcggaacccaggagttctccttaggttcgtagcctgtccattcgaccaaaagtttcttcttgtcgcggctatgatttcggatggcaaaaatgtcgaagatgtctgcgtcacgagggttcgtcggacggccgccttggctgcgccaatacgagaaaagcgactcgggagcatcggaatgaaggatagactctggctcccatgtcggggaaccacggtaccagccaaccttgagttcaacctcatcgcccacccaacgatggtcgaggatatcagtgaaggaatgctggccgtcccctctattgattgtgaggtctccttcgtcctcctcttcttcctcttccttagcctcgtccgctgcctcggcagtattcacttcggcgaggtctgacagttcagttgcgccagcctcagaaacaggtgcgggtgtgatttcagagccggactcggttgtaggaacgggggtggcctcagagacaatcgcagaaacgtcatcctgggtcgcaacaatcttaactttcgactcgattttaacgtcggactgtttctcgactcgttcatcggattcgtcatctagctcggactcctccataccaatgacgacgtcttcgtcctcttcatcgactggttggtcaagggcatcggccatctcttcatcagggtcttcgctggcgacagtttcatcctcttgggtcgagttaaggagcgatcgcaaatgcgccggctgggatgcaaaggttatggagtctgcgccatcgtcgcgggtgacggaaacggagattccctcggcgatggtttgattgtgctcgtcatccgatgagagatcattgagtcgggcggatgctcgggggaattcagaatgccggcgggacactttggacggctcctgaggcgacaaaaggcgttagccacagcgacagcaagagagagaaggaagcaaagaagtgaaacaaaaaaaagaaagaaacatcagatgtcaataaaagttcatacctcttcgcccagctcagggctgcccagaatgcgcgcggggaggcgaggcgccctagaagcacccttgcgcgaagctgccctgcccttctggcgcggcttttgcacgcggttcaggtgcgcttctatcggcggcggcgacggcgcgtgctgtggctgtgcgggttcggcgggcttctgtgggctgaacatgttgcgaaagatatccatagttacgcgactcgaggttcgcaggatggaagtgtgcgaattgagtcgtggggtgatggatgctcgcgacaggatgcgacgcgatggcgctggaacttggtgcgtggtcattgaggacgtcaacaacgaagctgtcaaggaaagagctggaaaggtggggaatcgcaggagtggccaatcagctgaccgagcgttcgtcttaggtcagaagccggcccggttaggtaggtatccacttcgtttccacggggcaaccaaacagcaccatcgccgcgaggtatggcgagctgcagcccagagcttactctggctccaacgtacagatgatgtgaatcgtgatgttgaggactcatggtggctccttgccatcctgcgggaatccgaagcgcaattcccgtctcgtataagcaatccacggcagcgacacagtagctacccgtaatttccacagctcgtgcttgccccttgagcgacgctcctgcccacctcagtgtccgcgcacatgccctaccctacagtcacgctccagaaacccctctccatccttccctcgctccttccttcctcagtcaggccatttgtattcgcccattcggagagaataggaatgtgcaagagtgaaatttcttaattcttgcatttccccttttcaattgctgtctcgcccgtggctgggctcgggaactgatgaatcacctctccgactcaggggatatcatgtgaatctccacaaacataagccaccaagccaccaagatcgagcgtcaaggctcaagcgaaacaatatcgcccgcccgacggccagtgcgcacagatccatcgctcattgacgtctacgaaagtaaagcccgaactagctcacactagcattccctaatgagctaggtaagctctctccgcgaaccaacgaaggcacgggtccgttgtgaagatcactcggcaacatggtggattttgctattatccagtttccccgaacacaattgccttagtaatgatagtgatagtgttcactaatcgagaggccaggattgtctcggtattttccgtcttttactccagcgaaacggccgatctactattgaaaattgatctcaaacactcccgccaacgaggtgggtaacatctggaaggaacatttcgtactaacggtttgaaacggatattgccgttgtactcgatcgcccgcgcgtctccaacgcccaccaaagcctcactacagatttaccatgttatgtcacgcgagcgtttggttaataagttgcaattgcaaccgctgcctctagcatctaagctgacgccaggcaccgtcacgaggtcgaggcgaagaggatcttttacttccccacgtcggctacggctctgccggtagatccgctcttcagggcctctgcagggtctcgaccatttcagctactagcaagaggggagagaggctcagagagcacgcagatgcagctatccaaactaggtacgcttgcctgagacgtggggagctcgattattgccaaagcaataggctatttattgtgccgtgtgttggcgccccagatgaaaggggcttatggctgggaaggcagtgggacaaaaggggacacccagatcgaggcgtttctcctgagaactgggcggatgaaactatttgggaaaatgggagtggcggcaacatggagctctcagaggcctggtcgatcatctcaggagcataccaagcaagtcgatattgctttgtctcaattccaaatccaggtacgtcggctgtacacgcagccatcgcccagtgcggtcggcgcagtcccacagagagaagccctgactgtatgtcgccgaacctgaccaaaccaacgtcaaggcacgcctcactcgtactcgcgctctcgccatccatcacctgctcataccgacggctgcctgtctctcttgggccgcggctgcatggcgagatagccacatagtcttggcgtgctctgatacagtgcacggatgggatatgtgtactgttaaccggccggtgtggtgtcacaatgcacagcagcctgtatgccgctccgtttgatctccaaggtcaaagcgtcccagctcaacacacggggctgagtcgatctgccatggaagcccttgcttaaatatgcaaatccgctcacccctaccctgcgagcccttccaccggtcacggcttcccctcccctcccctcccctcaacaccaacaccccttagcttggggctggcgcaagcctcgagtctaacaagtgcgaaagcgtctgcctcccgtttcctcgcgttgcctccacccgctaaagcgcctccacccggatgctgacctgtcaatggctgtcattggtgccaatcgggatttgactttagcatctcgttttttgttatcggaatgtaagataaaatggtccccacccctcctcccaattcggagttaagagggagtcccagactgatccgtttggctttgttagacctggtcccctggaaccccaccaaggtccccctacctcaccctgcatttgcccgttgaaaactacttcttgggacgaaatccggctctgccagctgcgcatcagtgggagtctggcctctctgcccaacaactcaccatggccgacccgaacacccagcagcccgtgcagcatcgctcggcgtgtgctgagtgccagcgaaggaagcagaaggtaggtgctggaaggagggagcatggcgcacccccgttcgatcgaggccttgtagctaatcaccgctcaacaactacagtgcaaccgtcaatggccttgcaaccagtgtcagaagcgcaaggtggcatccaagtgcgccttctctcattctgagccttcgtctgttggcgagaaccggaccacgggctcgaccagccagaagcgttcggctgattttgaggacgatgaccacgacaatgattctttgggagaggacgatgatattgacgccgacgcattcagcaagatgggatatctggcaggctcgttggtttctgacctgcttagcaagaccgtcataagcgtaagttcgagcagccctgacctgctggggagtcagtactgatgaccaacattgcagaagacggagtcgcctcgaccaccatcggagactctaaagacctctagtgaatgccctgcgctggaacgcgcactggccgcattgcctcaaagaccgcagatgggtgcgacaataccattccactggatcgtctcaacctgtgctgaccttgccgcaattcacagacacacttgtacagatatttttcaacacagtcaattaccactactacatcatttaccctccgatttttctcgatcagtatcagagatggtgggatgctagactcggaagccagcctctgtccatcgaatggacggcccttcttgtcattatttgctccgtcacgacgcaacacttggacgccgacacccgcgccaagattgagacagagatgggcgactcggtcgacaacctgtcggtgtcgtatcttgatttaacccgcaatctagcgacggcaatccctatcggcagttatcacatcctcaacattcagcgtatgctgcacacaatttattggttcaagtcggaagctcgattcccagaggcatacctcctcatttcagaggccgtgggtgaggccacagagctaggtaagtgtttagagagaattgcgattgaatttctgccttgccatgagcaatccactgatacctagcataggtctccatatcgaagcacgagcggcaggccttcccgaattcgaccgcgagatccgccgacgtgtctggtgtgtgctggacacgtgggactggtaaataacctgagtaggccctcgatgtcaccgctagccttactgattgtgattttgctaggcaattcgcctcgggcctcgcacgaccaacactgattgaccatggaacttcgagtgtggcacagccgaccctttccttggaggaattcaccccttcgccgcttttacacatgaagcttcagtcggaagcaatcgcactgttagcttcccggttccaggcgccgaagaatgtcgtcacccctaaggatattcaggagtacaagggaatcctcgagacctggattcgcaacttcccggccgtttattcaaccaccacgccggatgagtctaaagattatggaagcccatggatcacacatcatagattctatctccacacaatggcgtacctgatgattttgaaccccatccggcggtacctggcccaaaccttctcgccggagaccccgccagaagagcatgcagttcgacaatttggcgttgactactctcttctcaacttggagactactacagaatgggccaaaattgcgtcccatcgtgatggccgttttcacttcatcattttttccctctttgacactgtcgctgtcttgtcggcggcgattcttaatgacaaggataactccatcccgagacgaaccgagattattgacgcgattgacgaagctctcatcacgctcaaaaagatctacaacttatcaaaaaccgcgaagcaatcctatgatattttgtcccaactcgttcgacgaattccccgcagacggtccgctcaatccaagcgaaagcggttcggggaggttcctcaattcgtggctggccaggcctacggcgcgccagccctgatccaagaccctaccgtgtacctgaagccgtcctccctaagctcagacgcaaccaccagcccaccaagccagttctccagcagcgagagcgctgagagcggctccactccgcaaagcaatcacctccctactcccgagtaccagccagcctacttggagccccaggtgcaagagtctctcgcgcccgtgtaccccacggtgcagcaaccctgcaacatggacgctcattatgcggctcaacatgcgcatgcacttggacaatcgcagcaagtcctatatatgaaccctgctcacgtttccccagcggcgctacaaggcagcaatcaccatccccagcgacctgttgatatatttacaggcattccggcagctgatggccacatccacccgatgccgttcgagcccatcaatgatgatgtaatgggcgacttttcaatgctctggaattggaggagcctgaatcttccattcatctcctcccagatcccactaccagaacaaaccaattaatgctgtcgaccagacacccatggcgaccaaattttccttcttgttctctcctttgtctctctcatccccggtgtatgggatatgtacctaatgattatgacgtgatgtgatatgaccgggcgttttccaattgggggtgttttcagtggcaaatccagcacattagtgcatcttttgcttccttccccagttcaaggtttattagaactttaggtttcgcaaggccgaccttcatgtattaggtaatttttgaattctacaagatatgcattattatacccgcggctcgatattcattgcgtgtaagaaaccagctccctcattgtagacgtgggagtctaatgccaagttatggcagttctctgattagtaagatatgcccaccaacaggaaaatgacccactggaatacactgctaaaatttaatttccgcgatggctcatcagagacagacagatggtgcgtagatgtttttttctcacatgccccatctgccctttccacgagcaaaaaaaagacaaaaacaaagggtctggccggggattgaacccgggacctctcgcaattatgcatagggtttaagccctaagcgagaatcataccgctagaccaccagaccgtctatccattgcttgacgagcaagctggacaggacactttgattggcaacgggttttttattccagtatatatagcccaggtagtgaactgccatctcctctgtcatgccctttgtaggggttctcctaacccagctgcaaaagggccagagatagtcattagatagagctaatatagccttcacaatcatgctacctcgcacataagtgtgctatcaggcttccatctacgtattcattgtttcgggccacaccattgtttgatagaatcgagattaagagtcgaatattggattccttctagacagaatgcactgctactcataatcctatgctcaacagcttggttttcttcttggagaaagccctagcggccattagaaaccactacagtaagatcatatatttggatatattattatttaagaagatgcgagattagttttgagagcagagagaagcagagatgtgattattacaatgtactagggctaggtgtttatggcatcaagctcatcgcattagaatatcgccagatagaagaaaagacatctatgctcatcgtaatcaatccgactcctctacatctaaatggcaatcgtagccaccatcctgatcttcagcgatgtctaggtcgtatcgtcgaggaccatcattcggtcggagacggctaccagagccgtctttgggattattttgcaattcaggcatgtcgtacagccaatcggggagttggatgtttctcggtgctgttatgatgccgaactcgttgcacctcgagtgctggctggttgttccgtagaatccgacgatgatctggccttcgtcaggcactgagacatgaaacgttagtcacttgcgtaatgtgggtggcgaggaagtgtgatcaacgtacctagcgtttcgactgcgtgggagtaatgcttgttcaaggcgcccatggccttgccgttggaaagaaacatccggaggccacacaggtcgttgtgatccaccctggaaaccaagacctttgtgatctcggccttcctcgagatgagcagcttgcgagtcatgtggccgcccatatcggggtcattcccacccggcccacgacgcccacaggggatctttgtccggtcctcaaagtacacctcggcgccatcgagccgcgagccgaccctcaggtcgatcttgtatgcctgggcgaggttgccccgctggtctcgcttgttcagcagcacggcccacggccagtctccgtcctcgccgatggggcgcccgacgctcttccttcggaggtggatgtcggtgccggggatctgtatctgcgccatgcgggagagcatcgaccagacggggtattcggcatgcttgccgttcatggagagcacctggagctgcagcgggctgttcctgctgaagcgtgagagctcgttgatgcgaacgagtacttgcttggctgggttggggatggatgtcttgtttagcacggtgccgttgaggttgacctcggcgatccctgccttgcagttgatgaccagccgcagggagtcaccgtgaccctcgactgtgacaacggcggacgcgctgttcttctcaggatcggatgggtgtctgaaatggggaagcccgacgaagcggaggagatcctgtagagcccagcggcacatatgatccgtgtgtatcgtgatggggacatcgtctcgccggttcagcacacggctgtacgcaacggtcgagaggaagttctttgggaagtcgcgggagcagcccccgcccattatccctgaggtgtgcggcgccgaaaaggcgtgtccgacctcgtggataaaggcagtcagaccgacggtgcaggcttcccagttggtgggacatgcgttgcagtcatttccaaccgtgtccccgggcggtgtcgtgtccaggagacagtctgggacctcttcgataaagcgaggccaggcgtaggcgacgtgactgccgcacatgcctagcgatatgccggttgggttgtgtgagccgagagcggcgtggccggtgatgagattgctggccttgtcgtaatgcgagtcgaagatcaagccggcgacgatgggccgcgtgaggtcctcgaagggtggcccgtatctcttcatggcatcgaggaagatgccatgcagggcgttcttgtcccgggcgccgtcatactgctgggcgatatcccgatcgcggatctgggcagcggtcttgtcgctcctgacgacatggaccttgatggtggagcgcatacacgacatcaggctgtcggggtctggcgagaaggatcggctgagagaatcagccgaccagtgctcctcgaggcgaaaggtgcggcggccaagcccggcggcgcgcatctcctcggccgtcagggcctgccacatgcacgcggccatacgaagcttggccacggcggcgtgcaggttggagtgtgctggggagggcttgcatggagggcagtccatgaggccgggcgagtcggcggccagcatgacgacgaggtgaagcggagggatgtccagaaggggcacgtagtcgacgcacaccctgacgctgtcaccgccgccggcgacacgcagctggatgatgttcttgccgggactcagaatggcgaggcatttgaaccatccgtcgcacattggccagctgtgtgctgggaaggtctggcggccggcctcgttggccgtctggacctggacatggccgtctctgtctcggggcgagttgtagcggccgatgaggaggagggacttttggtggacgacttcgccgtcatggatgttgtggagggtgaacatggcggctgattgccgtcgccttcattgtggttgatgtgaagatgatgttttgtcctcgatagatcaagcagcaaccagaacctcaagcgactgtgacgcgcgttacaaattccaggtcactggctggtgctgtacttactcactaacttgaagcctttggcggtgatgatcagttgctggccgcctggagaatgtagagccagcggagcggagagccgcctactgggaccgaagatcgctgtgacaggctgaacagggcatcgctacagcgcatccatcgtgctggagagcgaagcaaggctggccaggtcgtacatatcttcgaggagcatcatttggtcggagatagcatccggccgtaattcgaaggccgtcttctttggttactgcactgaaatgggcatgaacgccgatgatggacaaggcgcggacttgacaaactctgccctgggaattgatgggaagtcgagtgggattaggctgatattcgatgctgttcactcatacacgacactctgcccaaacgaggcattcatccggcgtctctacagcgctatcattccccctttgctagcagtagcttcaatgaggaatcgaaactaggttcaagctcgattaggactgtgtctcaagcgaaagccgttgtgggatcaagacacggatcaagctgatggacctcttcacccttgacgaatcccatcgatgacatgcggtgcacagcatcggtatcattgcccgcctgtcatagctggtgcggtagaaccgaatggtatcttgctaaatatggagactggacaccctcaatcttgagcatattaacatctgttccccatgttctctctttcctcactattgtgagactgggcagagacatggcgcaaagctgagagtcgtgcagtcacaccgattgtttggtggcttgcggttgcattagacccggaacttctcacacatctgttttctcagctttggccattttgagagaggagggggtgtgcaatacaatccaacgccgagccgtgtgtgacaataggtacccatccctccaacttccaataccggcatctggcgtacacattcaccgtttcatcgttgcacggccgggtcaagcgagctaccggagtctattggagcgaatgagcctttgaggcgacctgagaaagctgaatggggcgtactcaggctcacctgcaggccggccccatgctctgtttcgccgatcgtttatgtgcaactccctctgtgttcagctcaacggcgctcgacccaggccaccgttgcacttttgccccatcctcttgcgggtttctttgctttttgactcgctactgtgcgcacagtgccgcggaaacatgcagctctgtgcccccccccctcgtagctgcaggcagggtccaggtagcctcgtttttttttttcgtgtagcgaagagaggggggagattggcgagaagaggtatcggtacctttgaagggccgttcggctgtaaccttgttcctttggcgggagcaccttgtgtatcatccgatgagatggcagggtagggctggatgacaccgtcgtcgcacgccacgaggataaagaggtgtttacagacacaggattacgtgttttattattattagagagtacttgtacatctatccatggaactgagtgtgtgactggagctaatgctgccccgacctccgactttgcatatgcatttgtcatgttggccgtcgttggtggcggggacgagctgcgcagccagatttacaccgccgctgcatctagagaatgacaccctgctgtggtagtgatgaatggcaggctggaatcggtgtagaagaggttggaaaggtctgcccagacctcgtatctgcgagggatacggccatctgcatgaatcatctctttctactagcgtaagtgacttgttaaacggtggcaacaagggctaattttggctacgtcctcaagagatactgagaggcttttaattaggttatcattggatattttcacagtcgctgcatgtgattcttacctaacctttcgtgccgtttggcgcgatgggacatgtttacgctcttgatccattcatagcacaggaacacgacaattggcacacactgttcatctatcctgatttagtttatttctaaattttttttgtcaatgctaatataaaaatttccatctttttggtgcctgtatataacgtatttagtttgatttgcgcgagactcttctccatagaatagctaatcggactggcagagcagagaacatgcactcggctctacctcgacggcaataactctatctctagatgtcttttggcacaataagttgtagcaaacatactctagataggtgggtgatggcaagatgcccgccggctgtttgaaacacttagatgttgccccttttttctccatgttgattggagttgcgagtatgattgaagacattgaatcgtgggtcttctttggccaaaatgaggaaggattgatgagatttctgaaccaagtctgtggccttctcccacatgtgctctccaaatatagaaaggaataattctgaaatagagtctttttctccgggggtcatagacctttcgacatagcccttccttccagccatggtgtagtgcaggcatcgagaagtcgcccagttccaggcgatcatcttcttggggggagagtgccggatggggagctatgtgagagagtgagagttacccaaaagacatgatcatgctcaagctcattgatgacgccagtaatacagtttctgaatgttcttgaccacttgacccctgttaatgaacaaaagctgctccccaatgtcctgaatttgcatttccggttcgttgccctcagccgtggttttcaatattcagaaagacagattcatccgttttctcaaaccaaacacggacaggcatagccgtcgtctgagttctgaacgatattacatctcatttgagaacaccgaccctaattcgctgttgacctcctcatatcaaggcgaaattattcggtgctgcgtagaacatttacagttggttgtccacacccaggatatcttcagccagcttccaggacacccaggcagcaaaccccattttctaccatattcccctcttcatccaggcattcttaaccctcgcataggcagcttcaggcgccagaacagaagccatgtatccgttctggatctccgagcagaggggccatgtgagtgcgacgcgacactcgttgtttggaggttcgcgggtcagggtgctccctagaggagacacgctccaggaagaccatgcctcttcgttggcgcctagaagatcccacatcgttgccctttttgcgatgtagtcgtatgctcgatagattggaaaggagaaattcaggttgcttctgagccattcgagatagataaataagcaattattcaaagagcattcctctccgcccggagttccaaccccgacactgtcctgggcttagatttcaggtggttggggaagaaatcaattccattttttccttcccttcacagagatgagccctgaattcacgcgagtgaactttgctcgttccgtttgtcgtagccaggttcaagtctttggcgcaacccacaccttctagagccctgcccatggctttgatgtcaagagtaaaataatatgcctgacgaaacccatttcgggtagaagagtgttttgtttttgcgggaatacgagagaagtcttcgtcaagatttccccttcgctgtaccactcttgcttggcttgagttcaggctgcggtaactgtccgctcgctcgttgatagttccaagaatgattcgagatgagcgtgatcctaatctgtcaaggaatgacttttgtttacgatgagtattgttcctggacagaccgcaggagactcccctatcatgtctacatcatctacccccccgaaacgccgtggttgattagaaagagaggaaacaatcgggatgagagacgagaggtctgcttttccgtcaaaatgcatgattccagccatgcgcgtcatagattccgttggatggtgacggcggccacctgcttagtgttgtgtccgcaataatcccttgttccatagctcccagtcgttctttcgagtctatgcgtgacatcccaaggctcaccgatatacgcgattgccgccaggccgctttgtgggtgtatcggagagcatcgctttggcaatggctattcttgcgtggggggggggtgatgtgttgaatgtaggtccaaagtacgctttgcaaggctcttggtgactttagtgcccctagtactgtaaaactgatgcctggtggacgtactgttgcaccatgtttagaagttttgagtagccgggtatgttgagagctccggttcctcacaatcacagtccatgatttcggtgtgatagaataaaagaaagtgaggagactgtgggtgaaagaggaagaatggtgtttaatgaagagacaataagaagttgaagggaagtgaggagcattgcgcctttctgtcaccacagcccttggcaagtagccgacgtctgctcatcgaccttgatcctgatagtttgcgatctttccgcttcccatccccttcgtggccacaaggtctctggctcgacagttgactggagttatcttcccaaccgtgggtcattgctcgggggacactttcagctccgatgatgctagctagtgatccggctcggaacatttggctaggtacgaatgatagagaaggtgactcggcttgctactgtctggtgagttgaagtttgaagagcctcatatgatcgtaaatagtttatcgttgaatggtcttctaactcagtaacaggcaactccacaaaagaaagccatgaatgaggggctgttgtgtagtaggagtcgatgcatccttaaacctaagcatgaaacccaacactgatgcgattggtcgtgttggttggtgcccataagggccttatgatgaatctcaatgtgaacgccgacaagacacgttcaactgaccgcttgctttcggccagctcatagatggcaactcctcgcttcgacatctagaacagccagattatgaacagtctagtcatccgatagcaattcgctcgcgttctttctctatacttgcgccgtaatcgcgtaactagcagctgcgcctgctcttggcccacaacttgttcctgtgacggccttcgatacggggccacgctcgcttttgtgagctcggggtttgtgagtcgggggcttcgtgaatcttcgaccgcgttggctcgctttctgctgggcaagaacaagacatttcgtatgcggcttgctatcttctcggcttggtgaaactgttcagtattggtgacagcgaaaagggcaccatggacggacgcaaccatacgacaggccaagtagacccagaggaccgctgcttccccagcttcagtcgtctcggggcaatgtgtgacctatccccaccagaaagcctcgagacagtaccaggtatcatcgctgcggctgacgaagtcgccgtcaccaaacttgacacagatgaaaagaacagacaaaccaaatgtttggcagatgatgcttatccatgtctgccacctggccgctagcacgtccttggctaccgttggtttgttgttgaactgcttatcgattgaatgtataatagctatctcttcctcgcggggttctcgtgtaggaaggttatgcaggtctttgaatttgacttctggccccgacttggtctttacagccagtacgtccgagtgttgggacgtgattatttccatacatcgcacagcgtgtggatatccgtggacataataatggacaagctcagcacttctcgcacatgtttgacggtctgtttccggccgatgatgagagtggcggcttttcaaatgcattcgacttctagtatacgatatctatttgtgcggcaggccaactcgagttgacggcgcacatccgttagcctgaagtcatcacttacagccctggctgcttcagctttcaggccattgtagcaatacttcagatcgtccgagaagcgtcggaataagtacaaaagatactatagaggcacggcgaagtgaccaagtccacattgattgtatcgtagttgtcaaaatggtagatatcaagccggcacgctgggtgcttcacctccaacgcttggagtaatacagcatgcttaacatggacttattgagaagaagccgtcgttggcgagcattggctctcgaatgtttggtctattgtcaaggctgactcggcctggaagagcccttggttaaagtgggcttgtagaaattgttgccctatctcggggcccagttgtcgagattgttcgtccataatcgcaatcttatggctttttgctttttggtgaaagtgcttatataagatggtacttgcataggattcagtgcttaggaaataaaacctaggtaatatcgctcgataatgaaacgtcttgagtcctggaagtctgctcaagagatcgactaggatattactgacggagtcttgattaacctcaacttcgtgattgccgttttgaaagatattcttatctgctaactcgttggaatggccggccaagtcgaactgtatgccttcgtctatgtcctcaggctccgctcttaaagtatcgagaagtccgtctaggccagaaatctcagcgactgtgaataggcatcctcaataaagtacaaccaaaggggagactcagaaggtagtttgattggatccgaccgaaattggataggtgtatccaggaagcacgtaccagtggtgtttgtgaaggtctggagatcgcctacgcccctgaactgggcgtatcgcaattttctgttgcccacaccgggatcgaacattatgctcatccgagcgcatgctactaaattgagactactacgatgtctcagtgcgaatctcgtacattggaaacctcacttgaccacatcttgatgttctcgatgggaagagattgaaccacggaccaaaacttcctccgaatttggaggtttaggtacttgtgcatcttcaactgcaccatatgcttggccggtcgtttcttggagtcctgattctggcacgattccgacatgtggacttcattgtcggcaatgcctttggatagtttatggaaaaccagagcatcgttcttgaatgggtgggctaactcgagagatggccttagttgaaagttccttggagtttttaatgcccgtttagctgcaagtatgtgcctctgtctttgctctgctatgtttggctaaactcgaagcaagaggcttgcgcgttgatccttagtcttcttggaccagcgtttctggattgtggcttcgtgacgcatcacgatggcccgcaggttatggatgtcgcaattatctcttctaggctgggacgctcttcttctttgcagatccttctagtaggttcgagccttgggggggccggttcttgacaccggtcaagtcggccacttcaggctggtataactgcgcacggaatgccgaccttaccgatattaatatgtggatcgttcgaatattagtttggagggtccgaaggaacggctgagcccgtatgaggtagatgttggacgaatggaagtcgccaaggttgcaccggcggacggccatgcttgaggtctgatagcgttcccgattttgatcgacctcgctagccacttgctggattctagaaagcaaaagctgactgtagtaggccattcgactgtgtttctccacgcttggcttaggattcagatgacccgatcgtcttgacgcagctctggatcctcgatatcgagagctcgaagctgcccgctgcccatcatatcgtgccgtggtattgatcaatttctgggaactgtgtcgctcgaaggccatctgatcagtccttggcaaatcgccttcctcaccagaatcgggctcctatataaaggcgtgatgccaggagctatggatgcttttattgagccaagaagttgtgttggtgatgccttggcagattcaagcggcgttggggaatgtacctgcttgatgcagctggagcccagtattttaacgaacccggtattgccaatgagcacgatgaagacattgcagtatcctcggtatcgagtatggcccccaagtattttggtcaagcagagcaggaagcagaaagccgtagcgtctttgcctttcctttttacggctgacggagtcttcagtcatctcgagtcaaatgatgcgggggattagcactgcatcttccgcttccgaatagtaaggtgctcgatgatttgccatgcttccccagtggtgaatcgtcggagtatgatggggtcttgcgcctatctctttatgaagagcgcgcaatctccataccaaatgaggccacatcgctcaatgttgagaattgcataccagggaggccacttcgctggtttgtttgaaagcctccgcgtagatccgtgaatccctcttcgaaaccacattttcaactacttattatcccttctgcccgtaatatggctgctgcccttgatatggtggctgccattttgtacttttattgtttcccattggccgtgtagaacaggacggcatatcccgaagaatcccaccttcttcccatagggcattagaatccataccgttggtcgacgaggatgtatatatccgcaatatgcccgagggtaatggcgggaatgttgtctttttttctcacgaagtttttctcccccaggtagtcttctccaccccagagagctataggcatctaatagagccactcccttaaatgaggctactccggggctgaaagatccgtatccggcgactgagatattcttgatgtttgttacggaagatagttatagttagaagttcgatcagtcgtcacagctcagatagttgtggtggcctggggttcaaaagactagcatagccgaagagaaagggtggcaagtatggaagagtctagggggacaaaacaggggcgacgacgaatgatttttcttcgcctcggtatgtgagaagtccttggtatcaaggttcttaacctcacgataccacttctcttttctctgcctcgctttagattgtggtggcgggttgctcactggatacggtttgtgttccctaagattggtcgatcttgccggtcgatggggtactcgggataactactatcacaccataggagcttggaaggtgcccacttctcgtccgcgtagttcattgcctcggccttggtgtagcccagggtgaagccctggtggtatggtccggggagggtaaccaccacctcaccggctttctggcttctattcttgccgcttctatttcaggtttatactgggtgaagcacacgtccggaggtgcgggaagtattcgggcatatatgggcatgtgcgaatttgtcggaaagggagcatcattgtccatgggatgactgcgttgttgctccccatcctttgtctgtatatacccgtgacttgagcatggggaatctctccgtcgctgaattcggcaaaaatccattgcgttgagatgtcggatctggcatcttcattgttattttcaaatctgtactcaaagctctcatccgaatcgacgaaaatcccatcagttcgttcgaaagatctaggattgggctggtgtactggcagaaccaagacctcgccatcgtcatgattggggtagtaccagaactgggagacaagtgcaacacatagggcgccttcgccacagagaccattgtgtcgtatttagtagatcgctcatcctgacttggtgctgcctttgacactgagcagcagtcattggcacgcttgtctggctatcgctcagttcgatctccatgctatttagtaaagagtttcgactgctcgcctctaacatgcccctaaggttccaaagtgtcatgaataaaacagttcaacctccatcgcgttgccgagtattgtgaagtaggagtttatgatgtgaacaagcttgaaactttccgcttctctatgccttcctctccagatcaaatccaagagacttcgggaggattaccctgtgttgtctaaactcttcactcttcgagggagtgtatttctggtgccggagcactgcatagctcgaaatgttgagaggttggcacctcacacgttcatacagccggcagtaatgagatgccccattgagctcacaactcgcaagagagggcgataagagctttggatgggataagagaagtgtctaaagatgcttatttctgtactgcaccgtatgtatctccgtcatggctagccattttcgtccaggactcgtagggctgtcaaagaccgagactttaggccgtagagcgtcggctcgcacatcagcgccccaatgatctctccaaggccttcaactggaatgtcttcaaacttgatacatgtcatggcagctgcatgaccccaaatgtctggtggaagtcagggaagattctgggtgaaagttcgactttattctccgcagtaatggctccttgtcgtttggcggccttataaccaggttcttcacgaaatatcttcatctggtacgcttcactgcctttctagacccttcctagttcggcattcatgaattgctgctttcgcccctgaaatataagtcctccaaatcggaacgtcaacagtcatttgttttgggtgagctttttgaggcgccactcaatgtgcgatgctttgggaggatatgctgagcatactcttacggagcgcataagctatccctttcacaccgtcgagggctttgtaggccgatagggatttgggatttatgagcttattgaaatggcatgttggtgtataggaatgatgggaactggcagtgatgttagctgagcttcaacacgtgaaaaggagggaataaacatgtgaactgaccttctctagcctctaggggagtggattttgatcaggatggtagaacactttcatctaaaagaccttcacatagtcggcatcgtacaggttccagttggtgtgccctagcacagaacagtaagtgatctctgcttatggtctttgcttttgagacaaagaagcagctcccaaagtccatcgtagggttactctttgccttcgacatcgatccaagtacattctggcgcggatttgacctgagtcaagtgcttccttgcaaagttaagacagattccatccattacggtaccagtatcaagaatgatccgtaagagcatcatcctactaccatcgaagaaggaactctccggttcgaaattgtaactcgggactgcatcgattcgttcaccgatagaaatgaggggcgaccgcataaatcagggatggcaagcacatggttgctgctattgattctagcgacggccgagcgccgttccggaacttccagaaaagctttccacattaacgctgtccctatatccctcgctctaacgcttcaagatgaagcactcttgggtctggccttcacttgttgttcaggcgatcctctgaccatcccaggactttgacaattcggtagagatggatgggttagataagtcttccatcctgtagacgtcgtctcattgatgtgtgtgagaccctaagcatggggattttttgctttctcattgcttggtcacagacaaaatccttaatgtgaaagcatgttgagatcactgggctaatttaattctggctagatgtaaggtcgctcgctggcggaggtagctcgttctaaagctggcggttgcctatcccaaggctggaataatcttgccgcttcgatgtcagggcgtcttcgaaagtttccttgctcggcggcggcttgtattctggcacgagatccggcgatgacacaggattatcctcatggtagcgataaaccacgataggtttgatggctaacatgatgattctcttgaggcgttcggggcatgtgtgtgggaaccctgttctcctgaggcgcctcgcgggcccttgagctgagcatattgaatccgacgtcgtatatagaaaccacaaaaagatatgagctatgtctcgagttgttaccggcatttgatggatggtttgtatgtctgtcttgtgaattggggggaactggtgtggcaatgtacgattgaaaatcgatggcggctcttgactttatcaacaacagaagattcagcggcctgcataggtcttcttggttgatcggtgtccatatattttttgctgagttatcgggtatgtctggttgttgatctttgttggttgaaagcttccagggggttctttccccgccatcttcgctgcaggtatctctcacttcactccatctggccgagttcaagtcctaggtaggagtagagcggtagagtgacatccgcagcagatgaggaatcgatgatataattactgccccatcgtttacgcgctgagaagtccgcgagtctcgggctcatccatggaactccaagccaacatgtacgtcctggcagcgagatgatatgttcgagtagtctagtcctctcttgagcgtgtccttgatcgcgtctgtgagtagtggaaatgtcaccaccgtggtgatggattccttggcaatatttgtcatgccaagggcctccaaggctagctcgtagagcttcttgcagcgcgagaggtcatccaaataagctgacatgatatctagttcgatggcttcacacttattaagcaatggttttagcttctcgatgaactggatgtcaactgttgacttttggactgagcccctgtgagatgaaagaatctcggcgccatcgcgaatgagcaatgttgggaatttgtcaacctcaacatttccaagaacattgaatgctttgttttcctttcaatgctcaacgaggacatccaaagctctggagtagctagaaggttttcacagtcaggcaagctgatatctagtaagaaggtgtttgggaatactcacgtcacagctatatccaggccaatggagagggttggggccttaatggcgagatttaaccacttcttcttcattccgtcgtcttagccaccgcgtcggcatccgctggaggatacccatcagagattgcaagccacatactgagacacaatcgtcgaaaagctagttaagtactccaatggcttcttcgccgacgctgataaaactccctgcaaggttcggagcttcgatttccagcctctactgatgctgtatgcggtagagctcattgagtctgactgacgtggcgcctgattgctgtagcttttcatcatatttctcatggaatttgattacaagaaaaggagtgggagtaaccaacgggggagttggccatcaaatcagctcttcagtggcctcatcatgtggcatccatgtccagttgcccttcacccaggatcgccgagcaagtatggttgcagtcttgcagtcttcctctctaaactcaagaatcctcccggccacggtggctcaattgatgtatatgtagtcacgtcggtgattggcagcagcgctgtacatattggcaagttggcgggctggaccgaatgccaaacggatgaaacagagacgatcaatactttcctcgcgctccgttgagcccatgatgaattgaagtcgtagtcgttaagcttgtctggtgcgcctgaaacgttgggtcatgcgcagctaagtgatcacgcagctgtcttgttttggtctcaatcgaatgttcttgttcacagagggcattcgcttcttccactttacttttttcttcctctctttcggccattcttcccttgatcatccttcttgctcttttctttccattcttattgctctttgcccgcttctcctgcttaccacctttgcctacttcgccttttcctcctgtggccgctgctggtggtctttcccagatatcaccctctgccaaggtagacggaataacattcatttctgcatcatgcagtgttgtgctcaacgtctgataccaaactaggacgatgggttcaaaaaccgagggtgaagttaagacccgcttcatctcatcttctcactccttggtcagagagcgcctttcagccaatttgctgctaaagtctgtgatgttatcatcacatcccttgatcagattgtctaatccaactaattcgcgtaaacggatgatgaacataagcactcctcttgacgagttccatgttgacttttgccgatcatgaatcgagccaggaaagatcccagggatttcagatccagcatgtgtccctagtcgaccgcgtgtggtaacacctgtgtcagcctcgatcctcaacccccacaaagagttggacgccttcctcaacgtctcgacgtccgagtggacggcgaatgacgcaatcagcctcgggcagtagtcctcacccccgagcagcttgcaatcgtatttctcggtgctaggtctgaacacacgcgtgggcgcacatatcgccagggctgaatacgcctgacttctgtttgcaatggggtccggatggatccatcttctcgtcgagataagagcgcctgtgcccttcttcgtgctatccaggacaacctcgcactctccatctagcagcctaggatctttgaaagtctcgctattcaaaatagttcgaagaacttggcgccctggatcgatccaatcaagagcgccagcaatcctccggccctatcgcgagattctgacggaacagcagcccgtggtcgcccaggggctccagaattgcgccgtataagtgcaatacagctcttggaggtccttgtcaagcaatgcgagtgtggtaaggccgagggaccatccgtcaagtgcccgtacagcttgagcacgttctcctccaacacgtccgtgaaggcgagctgctcattgtgggcgcccgtaagtggctaacttgcagtcacacaaggagaccaaacagaaatgctaaaacatgttgcatcgcggatagtctaagcagacatcttctttaattaccacatatagcgcatagtcatgttctcacattctctcacccactgagaatcgaaagagtcgatcaaggcgaattggtctagtgcttaaataggtcctccggggtcgtgggttccgtgatatggtgcgcgaaaagctttaggataccatcttcataggttgagctgaacgtgtacggcttcccaatggtatacctcgtggcagcccgggtgctccaagaattccctcacatctagaaagtgttgagacttggtcctgtagttgctgaggtacttctggtactgctcacggagtcctgagttcctattgatcgttgaagcatgcctggtgtcaagttgccacaggagaaattgctcgtataactccaattgtcccaaagactgcaataggttgtatgcatcattgattatgtcaccacacatctccgtaaggttatatcatctgttgtttcatatgatagatggacctgagatatgtgtgggtgcggtgaacaacgctacctgcttcaactgcagacttcatcttgcaacactttgttcctgggcgaacataagaattgtgagaccgcagatgtcggcaactgatgatgggttagttttgggaaaagatccgtgcgaaaatagagcggtgcacataccgttattcctcctcagcacctccgtctcgtgagagagcaggcaaagttgcttgaccgtggcatgggtcttctggggagagtagctccaccacgatccattgtcgcgatagccttagaaccagccgagccatgtcaaatttaatgaggatagaagacgggcactcaatagagatttgaatattttgggagataaagtgtagcgccctgatgccgagttggtcgatatggtcgtgggaccattgtgtctcaaaagtcccacagcgtctcctgaacaagatgaggaatcttcaaactcgtcagtccttcgtctgtcgtaacttaggctagaaacccgcgtgcgaatttgtggcatgattttaggggggttcaccgttgaacagaaatttcaggtgttgacccttcatctcataccagggctttatccaagacgaccgaacctccggggtgtgtgtaagtttaggccttacgactgaaaaaacaatgtcatcaacacccatccctcatctaccaaaccgcctcaaaggcgcctggtcgtcgtcatcgttcaacacatcatgaggtaggtagattgcactctgattcgcctcatgcctcctccctttaacacgatgtggtagatcgtgtggtactgttggtgcagctggtactggcccagccttaggctcttccaaaactccatgccatatagcttctaccgatgaccttgagaatgcatctttggcgggggtatttccacgcggaaggcctttaatcagatcttaaggagtcgaatatacctctgcagcccacgccccctcctcatggggcgtcttcctcgcgagcctttgtcttcggttttaatcttctggaatgatcaattccacgaaccagagcgtaatttgaggacatcacccctgaatctaactttatctctaagtaggcagacacgctgtttcttgccaagcttttcgatagcatcagctattttctgacaccttcatgctcgcactcagagagaagttttcgccgcaggattcgcacttggggctcccgcacggcttgataccgccatttgcttcgagttcccgcaggcgctccaagcacattgccgctgatgctctttggtcgggtttcttccgtagcatataacgccgtagaaactgcactccggcatcagaaatctctcgagatccgtcacatgagtaaattcgctctctatctggcggattgggtccggaaatcctggcagacatgatcgcgggtgatcgatgttggagaggtttggggtaagatacataaaaggtgttgcagtatcgtcgtgtggaagcttttgattcttcgatagcatctgttgatgtcaagcctgtatcgtgtaaggttctctaggtccccttggtccctaagcctacaacgagggttcgacgcggggaaccaacaaggttgatcaggtgatctacccggtttgtgggtgggcattcgggatgttgagcagaaacctaatatgcgtagccaagtgactcctcccggttggtgctcgtgagcccacacatggcttgtgatacgcaaacaacgctcaaggggatcatcagaatgaggaagtgcatcctgttgatgttccaggtggcgttttttttttcagcaaaatgataaaggtcaacaaaaaccatagtgacacttccgtcgatcctcctaggtaatttgtttttgctttaattgagttcccctgcctttacctgctctctgcctctccctattctttctttgttctctttgtgtgtgttgctgagttttcccgaattcctttcttcacttgatgttgtcttctcactcccatttgagtcaaaaacaatgccgatgcgagttctaaatttgtccacatccaggtcaatccagcagtcaaatgaaatgccgatgcgggtattagttttgtccacattatatggaagatgctttcaaggccgaccctttgctcgttctttctaggccttctcaataccgcctcagacgctctagccgctgcatacagagctcgcatccatcgatcccaagaccatcttggagtatgttacgtacacacggctgtagcctccggaagcaatcttgtagtctatacggaaccttccatcagcgattatgatatcctagttctgctagttctcctgctcaacggaaaatagggcttcactgaaattccacgatagctatagcacttagcgattgtataacatcggtcatagcagccgtctaggacaatgaatagggagcgatcccacgtgcacgtctcctggaacagtcgagaccattttgctccatggtggtctcccaacagaaagcgatgcctcttcggttccgtcatagtgccaagaatcttctcaccaagacactcctgacctatagaactgtgacagcaaacggcagatttgggcatcgttgatgggtcggaatctctgaaagccccaacagtggaaggtgtccataacaccaatcaagccaagtccttgtcctcctctagcaccgcctgaagagttttcaaagctcataggaagtaatgtgtctccctgtggctgcttgcaacaatctatcgttgttcccgtatcccactgccaggtcctagtagccgccatatctgctcttcgctgtgaggagttgacctatgcatgtcactattgtgtgcttgctcttcaggtgccgttccggcgagggtttgagcgttcagtacaggatctcctccttagctgcggagtctggtcggcgaaccatgtgcgtggttcaccttctgctgttggcccctgtatcaggaagtttgagtgtaccaaagtccagagaatatgagtgttatgcaagtgagagagagagatagagacaccgagagacgacatccgacaataattagacaatcccttctgtgtcttggactggaaattgcctcgataaggcgtatttgctttgggtggacaagtgaggagccgccccgccggatgtccctaaacccaccacgaggactcttgccatcttctgatgataattctcctctccaggcaagcctcattgtttcaaccgtatcacgccgtcaaggctcgtatcatcatttcaaacgtatatcccaaaacccatgcccaaatccaatgccatctcccaggagggaagacccgttcgccgttgcacttccctcggcccaactttccagcatcaagagccttgatatatcacctcttcctaaagtaggctcctagaatgcccgtctgacatcctatgagccaatttaatagcattcttgatggactggccccgctgggtattttctgtttccccatctggatgtctgcattataccgtagcatcgtgtttgggagtggctcaagaatgcctctgctggattaaacctcccagatgtggattgcctctctatcatcaaaagataacaacgagctagtgggcattgtcatctgcctggatggtctaatctgacctgatcgaagaacctcgtcatgtcatgtctctgaggcgcaagtgcgttgtgcgaaacaggccgctggatccaaatctggaccgagctggtggaactgtatcttgatgtttcccgttgcctgatgcaggttccttgaaaagtgccacactgacctagagagttttttttttgccgaggaaaaaagcccttatacgtcattgcatatgcgaagtccttccaagatacacctcctgcttctgactgcgcgctagggtcgagaaatagtttccgaaaacgcatcgaaggctcttgcgttgaagttgacttgttcctcgattttgcctctgaattccggaactatgtttgcagcctcttcctcgctcatctcctcctggctcatcatgggcaacaaaccagccccagatccacatcagggtgtgtgatgcactcgagactcgtctgtctcactgttgttcgaccctcacatgctttcgtagcgacaagtgtgacgggctcaacaggaaggaccactaatgtcgctatttgtgcccatacggggaggcggatgtctgtacgggcaatttcggcgtcaaccgtctggggtagaattagtgtagctggagaccaatcatcccccgcgagactcgtcattcccagcaggaccactgttggggcgtgtcgatgggttgatgaaaggaggtcgctctatgagaggaggggttgagcgggtcatgggcgggctcaagcgaggcacaggatggctgaggcgaggtgtagaaaagggggcttctcaatcttatcttattgctccttgaccagagattgcctttcagttaattggctgctgaagcacgtgattttatcttcgtactccttgatcaggttgtctaatccagttaattggtcgtggcgggcgcccgcctgcacattgctaccctgccatgtgactacactggtcctgctggtgcagtcttgtttatagttgtcaattgctcgcatcatgttgttgtactggagcgagccatcacaaggggttacaacccagtacgatcgagatcatccacgggtatcaacgttgcgcttatggcgagcgccgccccatcatggtagctggcctgtacatgaataaggcgccagtcgacttctcggcgctgggagatgcgaatcagccgtccctcgatctgcatgagggtttgggcagatgacgtatagggaagattatcccagaagtcttccgtgataggcaagcttgccctgcgtgagaatccattgttgtaaaattgtataagcaagcatcctgcttggcttcgggttggaattaaagcctttcttaatttgtagttggcccgtgatactgatgactgccttgccacttgtaacatccggtgcagcgtaggatagagttcgttcattatttcaaagatagtggtttgatgtagttatgggatcgatttccgccggatttcctagttcgaggcagccaggttccaagggcagctcacaacaagagttctcagtctggatcaaacttttccagcggtatgatccaagcccagtccctcctttctagctgggattgaatctgtattgagatgttaatcgtatatccgtcccggttgatctctgttccgggagcctggtcgagggttggattggtgattttgactgtcttgcgatttctttggatgggattagatcgtccgaccttgcggcaactggttgagccgcgcttgagtgagtaaaatcctccattgtgtcgcagttgattgtgatgaagttctggtggactgggacttccaatgcggttcgcatgtacatatggaaatcgtatagcttttctcctacacttcgaaaatgacaagttcagcggccatagtggagaagtgtatgttgaagtgacgaagacaccagcttttgagtgggaagtagtgatgggagaatcgtttcgaaatcgcgatggggcctgttcctgtatgtttcccagcctcccaacgattccagcgtgctctgggcacagcaatgttgggccaactatagaggcttccttccttgtggagaagaatgctttctttttcatttcagggcatgtgctttcgccagctccgtggtcatcacgtcctgtccggaaagtaccataaagatttccacctccgcctcccaaacttcgtctgtgcagctgaagcgtcaagcaaggacttcattgtcggtctagatatacccgtggcaggcattagccaacttgcacgcatgtgcaagttgcccttcgctatgggccacaccctccaaaatcctcttcggacagctcctcctcgaccgacttttcctcggtcaactcctcctcagccaacccttcctcagtgagattatcctcggtcaaccctccttcggtgagctccccgtccgtcaactctgacacgtcaagccccagaaacaaaacgccgtgttgcaaggtgagtatcggcccaattagcttgcatcagttcccggacggcaaggttcttttcccttgcacgtggacgcagtagtctcgttgaccatgtgtcatccatgactagtatcttgtatcacttaataaactatcgattcagtttcccttagttggatgatatgttaagctgcaatgagctcggatgattcccatctggcatgtcgatttccgcacctcgatgaggagtatggctgtgcttgaggaacaaaccgctcatgctcacgggtttcgagggttggccaacactcagccaaatcagaaaattcccaaattacatcccaggaaatgattttggataggtacgatgtcgcagactagcggacccatgagacgcaaattgagcgtcagcaagtggtggaaagggagaaggtcaaggaagagatggtaatcggcaggcatttcagcagaagaccagaccaaggagtcgcgtcgatcgactcaccctcggaagggggccgagggaggtcataaatttctttttatccgttttctagatgttggcagagccccggatcgtcatcatccgcaagggaagagcaggtgtcccaatggaacgcttgacagacaacctcgctgacagagatggtggcctttttgcgaccaacagtggattccattactggaataaacgttggcttctgtaggcctctgacaatcttgagaagcgcctcatatgtaggagtgttgtccttcaagaaatgcatgacagcgggtgattggacctttttggagcttgcagcaccatctgaaggatgactgccatgttgttaaggtggacaagagattcgggaacgtccgatctgctcagaggctgaaacccaaatgaagtcctgtcagaatatatgacgccaaaacgagggaagctaccttctcctgatcaacacaagttgacaagtcaaacgctgatacagcaagtaggcctttttgaagatgattggcatcgagagatccaattttattggacaattcactgttctggtgctttagtggacgaatcttgttgtttgagagttccagattagatttaaatcgttcccttgctgatcaatgcgtgccttgtgggccaaggttgtttttgaaactgtcctggaagtaaaaaaggatgttgttcatccgctccattcaaggaagtccttctgggagtatcttatagttcggaaaattcctgtgaaaagagatccgcgccatacagctccttgggggagggtgaactccagcatgcacgtggaatccagcccggagcatctggacgtttgcaggcatgcgcgaaagctcccatttggcgttggtgattacgttgtgtctagagtagtttgtggtgcgttgcttgacgtatgagtgtaaaggttgcagacatccataaaaccaaagactcaacaaggagcggctggacagtataacagagtgatcgaaagattcattagccccaggttccaccacagcacatgtcaacgagccctggagtcggaccatctggacaagtgtaggaccacacccagtcccatagttcgttaatggagtttcgtcgtctgattcctcccccttcctgttcagctgcgatggccgtcaatgcgaacaactccgtcccagaccaccaagtgcgagggaaatggttcggcagatccaatgtccgatttcgccagctccgggaccgcaaatgtatgtgccggatatgctagttaacagccccagaacaagctagccagcgtcactcatgatgaggagtcacttctgaccaacccggtgatggccttcgtcgtcgccagggcctttttcgtttcctcgtcaaatccacaccaggaaatggttcgggaagacaggcagatcaagctcaaattcacctaaggtaagagttttgtaaaccccacgacctgtagcgagctgcaggtgtaaagcaaattttatcgaatccgatcaaggcagaggagtttcgaaaacggttgggctggattatcggctttgaggatatcttgggccagctgtaccttctgctctccatactcgccgccggctcctccatcttcttctgtatccgctgataccttatcctgacccaatcaaagacctatgtctgtccccgtccaggattgaaacgcgctctttcaatcttttgactaattggctatacttccgccgttgatcaaatcgcaactggtgtgcatgttccaaaaggtaaaattctcagacgtattttcgggtgttccatcttcttttttattgctgaggacgctgttgacgtagtaaacaaattgcatgaatgcatatttggttatatgacaaatccgtgcttgatcgggtgaggctgtggtggaggagccaataacttggtgagggtcatgggagagcccaacgctattggcttgatgtctgtatggagatggttttatgtctcggtggcagtcttgattatatcaagcgttccacggactctgaaatatccatggcatcctttccacacgacgacagtgacatatccgcatagttgcgatcctcgatggcatgtccgcaccgttgccagcctcaaggcaaccaagacaacatacttcggtgaagtcttaacagaacattccggacaatcatctccttgggcagtccagcgccataagggttgttgttggggtaccaggatcccctcggtgtctcgtaagtcagcccctcccaccttcctccccgaaatgtgggagtatctatgcctgtaccagcgatgtctgcgtcaaccgtggtcaccggaggactctgatatgaggtattcacagccgaagaagaatggggaatgacaacagaaactccccctccatacataggctggaataaaactggcggcagcaaacgagctcgcaatgatgggtgctagaacatactgcacgaaacgcaaaatgttggactagtctcatcaaagagaaaagagcttgcaagattaggatccctcttggcgacttccagcaacattcccatgtttgaataacatgggtgtcataagattcaacaagatgactgaattcctaaaccaaaaatgttaatcagaagtttcaacactggccagtcagtgggttcacttacagtaaccttcttcagggaggagacatgatccacgtctgccacctaggcgacacggagcaaagtctcgttatatggcaggcgacatcctgctctaccgccaggccctaaccagaccgagaaggctctagcaaatcagacctttcttgatcattatgaccccctcgcaatatccagcccctagtaggtatcggtttgtgtttctccgccatggttaatcttcattctctcaaaatgatgactaaacccggggcaagaggagtttgatgcttggcaggatagagaagaagctccaattcagtcctgcggttgagtgcgaacgtcggcataccaccattaatggccagtttggccaacgtagtgtcacggcactcaagcccaatttgtctcctaggtttggcattcgcacaagagagtcgaactgcaataggtttgtggaatagtaagggtacttctcaaacttcccactcagtgcagcaagatattcacgaactctggcctttcttcgacgtggcaagatgatctaccaaagaaccgttttgccgggagaaacccagtcgcaattcttcgaccgggtctgaactgatcggtggccaaagcttcagatcgacgcgctcgtcacccataaaaatctgcagcgatgtcgaggctggtgtcatactcggacggaagctcggcgacctcaacagaatagtcacgggggaccaagtcggttgattcgagaaggcatggttaatttgggtgatcaacaagacaccagaacaaggttgggtgattgaggaagagaagccgggccctgccacaaggcttatcacaccaccatccatgagggaacttcggtcaatgcgttcctccctatcgactagtaacttcacaaggccattgcggagttgaggctgagttgcaacaccgtatacgggcatccccaagttggggcactgcagctgccagcagcattccgtcaaaaccggcggtgggatgccgttcggatgtgtcagtttcagtagcgcgagtcccataaatcgtgggtcgaccttgcgtctcgccgcgagaatggcttttttgtcctttgagccaaatgtatgccttgcgccaatagcgtagaacaccacaggcagcacattatccaggactgccatgttccaccaaccgtttgttgtaattcctcccggagatgtggcagaagagtagcaggatcgggagttgggggtggtgatgagataggctgacctcgctacggcagcattttatgttgatgtgatttgactgccgggaggacgagcgctcgtgagttgatgcacctcatgaggaggatggctccggaacgggtggatgaatgtgccaaagtctgctaagcccgtccttctgaatgctgccatgtccaaatctttctcgttttgggccaatgagtagcccagatatttgggatccgggtgtccaagggcgatataagtctcatcaacgaaacggaaccgctggcagtgtcttctagggccttgagatggcacagagacaaacgctagcagagggttcttggccggatgggaattgatctggactctttcgtgccctctccgcttgtgggaaaactgtcacgattctggttcggccaccatttcggatggagatgtatggcctatcaggtctcaaatccaccagtgtaagaaatttctcataaagggtgatcaagacgaggagatcaatctagcttcggtgccaaggacatggagagggagaaagctaaaaaggcggaagccaatattccggtgtcatgtgaactgccaaagaaggaagagttagcttgcagtcgtgtgcgaaacggccagtggttacatactcggaagcaggccttcggcttcctcaactggcatgcaagactccggagacaacatgttgtcatggcatccacggctaccggattctccaggatgtcgagtattgcgaccttggggaccggacacgaggcaactgctccgtccgaccaagactgtcgcttatcggtataggtcctcccctaagataggaagaagatcagtatccagctggcgatttatccgctctatagacatcccgccagcaaatcagatgttgcgaccctgcattattagagtcgacaccattttattcatgcatccttgagatgccatgcaatggagacatctcccttttcgcaaacatccgtgatctttttgtcgagttgccatattgaatgtcactttggagtgatacggcgcgcgcagtggaatggccgactaaacagggacaagttagattagatctcgtagtcatgcattaaggggtggtgtggtgaagacacgtaccatccaaatgatcctcacattctccgtcgtctaaccacatgtatgcccccgggagcgtgttcgacggatgattgatcacaccgccacccgccccaatctcatcaaggactgctgcggcattcccagctgaatagctctcagactatggtagtgttagattaggaagatcaaagacgggagaagcaagatatctcgatatctcaagagacctacctcagccacatttgagggcgtctctctccagctcccagccaccatcgtttctggaggaccagggcaagatgaattcctggaggtctaggatcagaggaattccattcccggagtcttccattcgacggtcagtagagatgctgtcaaaggagactagcagtcaagttgccaaatcgtccccaccgttcatcatgaaccatagccttgcgctagagtgatgttagtcaatataaaactaaatggcaagttcaccaaggagggagagttggctccagaccataaagtgacttaccaataaattccttctgttcccagtggagaatgactctcgttgtttgagaccaaagaggaaggaaaccccaaagcaaaacccccatcgtgtgactgaggaaatagttcctctatgctcaaccttgacttgtctaagatgaacccatcgtttgtcggatggctgcccaaatgtttggtccatagtcaaaacgtcccagccatgggaaagaagcaaaggtaaggggcatcttggggctgaagaatgatgttagccgagtcatcatgaaaagaggcacaaggggggctagcttcaagccaaggtagtaacttactcatgaagttatcccccagtcatgtccctcaagatcgaagggttaggtgtgccagtgagggaggaacggcaccaccttcaggggctcaagtacaaggttagtcgaatgggcatgaagtgaaaaggccaaaggagggttggcttgaccacaagataatacacttacgaaggaggccgtgtagcttgccagcccatctatcatcaacctctttggggcttgagactagaaggcatattgatgctccaaacagtgctagattgatgaatatcgaggaaaggtagcttcgaaccatgagggggtacacttactctcgtcgctggccaggcccagcaccaatgagcgtccaaggcgtgctacgcaatggaaggatggacgggacgaatgagagggaactaagcaatgttagtcaaacgaacatcaattcaaatcacaaagcagggttagcttcaaagcatgaggcgatacacttactagcaaaagtgaagctctccagacttgaccatacccaggttcccaagtcccatatttgtgggaaagggtggccacccctaaggcagagaaatgtaagtcaagtgaacatcaagcaaaaaaacacaaaggaaagttggcttggaacgaaaaggaagtgggcttacccatgaagctgtgaagcttgccaggcccattgatgatggacctccccatggctccaggccatggggggggggggaatatatagaagaatgggggaggaggtggtggtggtgaggatggagaggaaagaaaatcgagagggaagttgggaggaagacggtctatttatccccaaattttggaccgccagaagctcgcaatcactccagtcaactctgcaaaaatctagcaccttctacgaaatcaagtcaaattctgcaaagcatcacacagggcaccataggacacgtcagagaagggggctggcgcccgcccatcatgctggtaaacatcaatgccgtgttgtgtaaacgctctgttccctctctcaaaacaagctaaagcacgattccggagagtatctgttgttgtgcaacacggctcccatccgctgacgaatgaggggtgattgtctgagctgtactatatactacgccggcggcagtctcccgcggcctggacgtgatatgcctaatgccggtgactgctgcatcttcccgtgggctgaggatcgagaccatcgccagcacaccaatgtctcgcatcaggatgagaccttttttcatttcttgaagccatgcctctccctccatccgggcctgtgcttctcctcccactcgggcatgtggtcctcctcccatctccgctcggcccttcgcaggatggccacagcattagtatggttcctcttttctgcgacgtccctcgccgtcgcaccctccgcatccttgatggttgggtccgcgttccagtatcgtagcaccctgagaacctccctcctctcctcgtcgccgtcctctgccttgctggccgcgtagtgcagcggcgtgcgacccttggccgtctgcacgttggggtctgcccgacccctctccagcagcatctcgaccgtggacgctgtggccgaccgcgctgcgagatgcagcgctgtccgtccaccgtttgaccgtgcgtttacgtcggcaccacggtcgagcagcagcatggcgacagccaagttgtcacgatcggcggctaggtgcagcgcggtcaggccctgctcgtcgcaggtgcgtggggaggcgtgacgcagagcctgcaccgtggcgtcgaaatttccgtcccaggcggcatccagcagcctatcgtccgcgtcatgggcggagtgattcgagtggacagaatggacgctgtcacggtgcgacggtgactgctgcgggtgagggctttgggaaggctgccgcgggctttgtgactgtgatggccgtcggggatcggccgatgatgaaacctgagcggcagcagttgccgtgtctgccttggccgagggggacgagactggtggttgggtggtgggtgagggcgcagccgcgggtgcctgctgcgtcggagatgcagcggaagcaggtttttcatttactccagacagaggagactggggcggatgggaagctgcattagctgaggtctcagtcctactgccagctggcacgggttgtgatacttgtggtgatgctggcactggctcggatatcttgggcacgggaggtacgttggtatctacgcttggtctcaccccagcggctggcacggcagaaggctgtgccatatcaacgggcgtaggagcgggtgaaggagctggtacgggctgggcagccgttgtagcagctgtcgtggcagccggggctggggtggctgcagcaggaggttgggcaacgggagctgcgttggccttggccgaaggctctggactgggagcagctggcgtgggagctggagggggtatcgggctggccccaggaggaggaggcttcatcagggctcgtctgttgtgagtatagttagtacggaatcgagaggaatgacagaagagcgattgtaagtgtacgtacgagtagatgttcaccatcagagtgctaagcgctgacaactccttttgcacatcctcttgggccttcttgacctgttgctcaaagtcgttcttgtaccgatacgacctccagaagctttgcatctggttgattgccgtctgacctgaagccgacgttccctcgctgctgatttccgacaggagcttcgtcatcttttccaaggccttgtccgtgttcttaatggaggtttcgatctgccccttgagcttctcaccctgttcgccctcgaccaggtccggccgagccttgagcgtcagctgcacctggttgatggtgtccctcgcggtggcagcctgtgcagacagctcctggatctcgtctggcgtctcgctcatctcgttgagccagtcaacccactccttggccgtctcggcgtgcttagagacctccttgagaccagcgtaggcagcaatggcagccggcatggaagcgaacaggttggagcctgacgacgttgctggctttgccgcgctgtcgacgctctgcgagtgcggtctcggcggggcttcgtgtggcctttggtcgtgccttgagtcgtttctctggtcgtgcggcctatattcgtagggtctgtagtctgacggccgaggagacgcatgcggcctgctagaacgaggaggcgtatcgtccctgggtatccgtggcgaccttagactctccctgcgcccaggagacaccggaggtgagtccacattgctgtatctctcccctgacctgtattttccctgtactgacggccggcgctcatagagcctagggtcatctctagcttcgtatgtgtaccctcccgacgtcgaatcgcgtcttgactgggaaggtcgccgcctgtagtcgacactggacggacggccactcagcggcggtcgttcatccctctctgggggagccaacgaggcgcggcgccgaccccgatcgtcctcccaccgctcggcgctcaggtattcatctcgatcgcggggcggcggccgcgagtaccgtggctctgggctcgactcggacgagtcccgacgccggctgtgacgctcgtgccgcgagggccgtgacgagggggggtagggatcggggctgcggggtcgtgcgtagctcgcccgcctcctcgacgaggatgtgtgctcttctctgccgtctcgggagggccgcctggccgggtcgtaggatcgcgagcgccggtcggacgagcggtggctgctggagcctttcgagtgcgatgaggtggtcgggctcttgagtttggcggtgagcagcttgatgggcgatagaggcatcgtcgctgtctgtcttgccgcctgggcgataggcagctgtcgctatagcgtgcgctaacagacaggcagagccgggtaggtaggtgaggttcgttggtggcggatggggaggcaatgggaatgagaaaaattgtagttatgaagcctagatatctctctcgggtccagcacagtcagccaatgtcagctcggccctgcttatcctgttgtgccaaagcaaatatcgtcgctcgtgctggtggtgtggtggtgttgcgtaggtcggtgctagcagcagctatggtggaaatggcagtactaaaactggcgacggcgtcgggggagatcgacgagagggacgggaggggtaaaagtggcaggagaatcagggcattatcggcagcaggtggcattaaagagctcttgatgctctgccgtgactgctgaggttttttgccgctgcttggcgccagtctgcctgcctgcatggcatccttgcgtctgcctaggcgccctgccctatcgtctcaccctgtctggaggaagaggagctgagcgtctgaagctgattctgaactgcctaggcgtggggcagcgatgacgcaggcgcatgtggacgacgataacaggccaatcccatcatgtgcgctgcctcacctgccccggcccggccctctcgagacttctggaggccccgtatggcttccttctggagggactgtcggtgttccctatctggtgctatgtacggattcatcctctacgtgatcacgccctggcacatgacggcggcgtgagcgtctctctcatgctctgccgccctgatgacgccgcggtggacaacttcccggcagctgggtcgataaaatgaaaagcaaatcggagagaattactatgtaaatccggagtatacatgaatccattttgacctgcataaagaggtgtccaggacctgccatgagcgaatggttactggcgccagagtttcaactggccaacgggaggggcaccgcggggcgaaacagctcgcattcgaccattgagacagcggcggcgattcacccttgacgtcgacgtgcttaccaggagcaccgacccccatcgtagttatgtcatttcgcgtcttcggcgataatcattgcgagctatattgcgtcgagcagatgagtgtttaccgagggttgacgatggattcaacctgggtctaggttagggccacgatagcgggcgatcggcccatagcacgatgcctagttgagaagatgcggtcaacgtcaggacatacgtcggcgagcatggctatgttgtttgttccacttcgctcggggagctagacattggctcgaggatggctggagaggctggccagggaatccaggtcagacgttctggggtagactcatgctgggtcagtcactcccgcacattgatcccatgttgtgactaccaggcattagacctggattttccttgccatgacttgccatggtccaagtatatatatcaattgatcacattggtctaagcttcgtaataaatctatataatttactgttacctttgagctgcttctgctccagttcaccgatatgggtatctcagcctttgtccaagggccaagctgagtgctgctgtggcgccgctctgaaaatagaagtggctgagatgcagatgcgccacaggcaatccgtgggcattgcgcttactaagtcatataggtactctggcgttccctcgactcaacacgaggtcatcaccagcagcttcaagagccacatgaccaatgactccgagcaactgacctgaccttacttgttctattgttccgctcgacaccgagcaaaatggcctgctgcgccgattgatccatccttcagaaccaacccagcttccatccacctgccacccccctcgccacgcaaaacgccgcaaacgccaacatgtaagccatccccccgaacagaatcaacgccctgtacgacccggcgccggccccctcatccttcaccaacgcccccgcgatgggaatacccaccagcgccccgaagctggccacgaagtacgtgatcccgttcgccttgccgtagtcctcgatccggcacaccctcgacacgcacacgggcgacaggctgatggccgcgccggaccagaacccgaacagcgccgcgaacgacacgatacgcacataatcccccccggcagtcaaccacagccccagcacgagggcgccgcagcacagcgacgtggcgcacatggtgttgaaggcgccgacccggtcggccacgtagcccgggaggacgcggccggggatggcgcccgcgttgagcaccgtgttgagcaggagggaggtctgcaggcccaggccgctgcggaccgcgtaggaggagatatatgagtaggggacgaagacggcaaactcgacgaggaagatggcgaggacggtgatggcgaacttggcgtcgcggagcaggcggaagtccatgtacagcttcgcgtccttgttgtccgggatgcgcttgcggaggaagacgttggcgacgaggaggaggaccagggagatgagggcgacgacgcgcatggcccaggggaagccgatgcgcggggcgaggtgctggatgatgagggagaagccgatgcctcctagaccgccggccgtgcaggccaggcctgttgcgagggcgcggcgcttgcagaaccagtggcccacgactgagagggctgggttgaagaggagggaggcggagatgccgccgcagaagccgaatgataggaggaactggtagaactctgtgggaaggttagtatcgcgtagttgcgtagacgttctgtcgatggtgtagatgcctcaccctttgatagactgagaaacaccatggacaagactgtgccaatggagccaggtatcagtagaagtttgatgtcgtgagcatcgaaaatcggtcctgtagatcgtcaacttcgtggcacaacaaccccctcgcagtgcaactgaccaacttgggcgccacaagcggtgatgaagaaagcgtaaacactcaatatccaacccgtcgtgctctcaggtatccccttcagctcgttctccccgagccaagcgtggagcaccgcgagcgtattcatcatgcccaacgggggcaccatggcacaccaggcacccacaaccaccatccaagccgtgaaccctccctcgggataatcgccatcatcgtcttcttggatttgtatcgacaggcctcacaaatgcctgttagctgggcagttatcttccaagttaggagttgactcacctccatcggctacttctggttgagcgacgacgggatcctgttgcccctgacgagaagctcgcaccttcatgacgtgagaaaacagttcctacaccggaaatatcccccgcaactgtctggaattgaccctgaaacacgagacacgatgtgaagaactctcccttttttttttcttaccccgcggtcgtccgcggggctgatcccaccactatctcggccaggatcctcggaggtcgccgatctcgccaagatttgctctgcactaccttgtcgcccagcatgggcgccaattttcatcgtcaaatgtaatgggagattgatggataacatcagaattctaagcgggatgaatcgacggtgctacgagatacacatgctcacgaacattgtcaccgccggcacgaaaacccaagtcttgatccagaaatgtccattttggcatctcgccagcttgagagtacacattaaagaataaaataaaataaaagtaacccgtttaaatcccacccattactcctgaaatatacaaaaatgtaccttcctctcaacccatcatcaatatcgtgtcaatcccatgtcattaaccccgttctagtacgcacccggaggaggaggctggtacggctgctgagagttccccgacccgttgatcgagttggggtcgtaggcgtacgagctggcgggcggctggtacgcgggggccgcgtaggggggaggcacgtaggcggccgagctggaggagggggagacggaggagtggtagggcaccacgccgctggtggacgagtgctccgtgggggcgaccttgacgtcggtgacttcgccgtaggtctgggtcgggtaggctgtcgtggtgggaggaggggcgtagtatcccgtgttctggggcgcgggcgagctgtaccccgtgttctgaggtgctggcgagctgtagccggtgttctgaggtgcgggtgatgtgtagccggtgttctgaggcacggctgcgttgtagccgtatggtgcgttggggttgtaggcggtatcttggtggccggcgggcgcgtcctgggggttgatgggggcgtactgcgtcttcatggggaacatggcgttgttgccgctgccggccttgatgggcttgctgtgcatgccggcgcggcggtgcttgcagacgacgatgctgtggatgagcagagagatgaagtagaacaggctacaagagatggttagtcggactatggtcctggatgtataacgggaaacgcttacaattgaatggcggcgacaccagcggcagcagccagaacaggacccaggacgtcaaacacagcgtatagatcctgcatggccttggtgctgctcttgcccttgaagtcgccgaggcagagaccattgtagcagctgccgggatacaggtggtcgtaggccaagatgccgacggcggcgagggccaggagggcggtggcgatgagccagaagagcaggaagagcatttcgaagacgaggacggcccagtagttgtaggcccggggagcgcagcagtgggcgctcacgatccaggtgttgacaatggcagtgacgacagcctattgaagtcagcgagggcacattactttggcttggcatcaccgcaaacttaccagagccgcgacaaaggcgagacctgcaccttgggccttgctcagggcaaagcccgccagacccagctcgaggatggcgaagatgagctggaggatacgcaggaaggtgaagccgccgggatagggggggaagtgctccttgcccggatcgcgtctggtcttggccattgtgaatgagttgtcggtcgatgtgcgagtcggacggagatgcagatgttggcaaggcggtcggtagtcggtcgatcgaagcgtcgagaaggatggccaacacgatccaatcgcccacacgagcagacaaacacagataagaatggcggttcactcaagcacggcgggaaatggtaataaatatggaagaaaagggtggtccacttcagataataagacgagtaagacggacgatctcgtcaacaagcttgtacgactagctcggtgggtgtggttggatggcccctaaaagatgtgatcgggagttctccatcgcaccagaagacccctgtttctgcaggcttttttcctgcaatttaccaacacaccggccatcccagttgaccttagtgcgtgggcgattctgccttgtggtccaggtacgggctcatccttgtccttttccatggcgcgtccttcaaccaacagcacgttgattgggcatggttgtgctgggcagggctgatgccgttctgccctcctcgtcaactgccgtgtcccataatagcccctatgcttaaggactcctaggctggaggcgtcaagtaactcgcggacggcggaaaagaggcagcgcgatgcgacgtcggacactcattttaggcgggagagtggggggaaggctgagccatgatcgcctgttctattatgcatgaacccatggccatcacatgcaccggggtggacgaagccatagacaagcaaacaactgccgaatgtcaagtgaatatcgtcagaacaatgttctgcttcctcttctcctcttctctcctccgttgcggctcacgacagggcgggatgggatgggttccttgaaaatggaggttgcatcttcatcccacaactaactgcatcaggagatggagagaggcgcaagtccctgaagaggaaaaaaataagctgcactagcaactggattaacgctcatgctaacgacaaaagcaccgcccaaaacgtccagccaacacccgctaatattatcccctcagccacccagcgccaagtcgtgcccaagcaccaaccagcacaaaccgctgagcctgggacgaatcgtcgcccgtcccgtctatgatctatcaatctgatgtattattattatccatcgtttccagcgtcaccaccgcggcgcattcccgtcgcccaagcctccttccccctccaccatgtaacccttcttccccctataccgtgcccgaagagctgagatcgacgccgtccttgttgtcatactcgggcttcttcttcccgctgagctggaagtccgcgtctggccagcgtccctcgaatgcgacccccgggtggaggacgctgagcacgatgcacgcgatcagcacgagcgtgctctcgagaatgaagaagatggtctcgttccgcgccagcttgctgtcgaagccctcgctcagctccgcgactcggtacgcggttcggacgaggatgcagagcgtcgcgagcgccagccctatccagctccgtcagccactaaatctagataccatagagggcccaacttaccacccatgaatgccttgaatctcggcgatgattggagtgaggcgaattgcgggttccatgtgctcgcgttcttatagaccgagtaggcgacctggcacgacaggagcacgtagatgccgatcgcgccgaggtgcacgcccagacccgccttgaggatggccagggcggtattgagcgtgtcgaggtcggtctggccgacggtgagggcgccgccgccggcctggaggacgagggcgaagaaatcggagagcatgaagatgatggtgatggtgcgcgggcgcagccaggagacgtgctcgccgtagacggcgatgatgcgcgccaggcagaggtagatggcggcgctgatgaaggcgggaccgattgtgacgcagacgatttgcctggaatgcgttttgtcagaggtgaggcgtagagggagtctgagttgtagacgctggacttacatgacggcgtggtctttaccctgatggaggaggatgcgcgccgtgtacgcgatgacttcgaggatcaggccggataacatgccaaaggaaaatccccatgttcggtatttcaggccaaagaagacctggggaagtagtagaagtgaataggcggcgaggaaaaaggagttgcctccgagctggtaggtgaggaccatggctggatgtgtctatacggatcctgctatgtgggtgtcttcgaggtgaatgaaagcactgagtgagtgtgtcctgccgcccatctacttggacctcgacagagcagcaggtgaggctttatgtctgccatcctgtgtctctctcgccaagtgttaatctagtcatcttgcgtggcatgaactcagcctccagagatgaagcagattctctccattactagacgaaccggccaatgagggtgcttctctgtacaatcctgctccatcggaagctggccctgcccattaatcagcctcctgatgtacgagttaatcgccgggatgtgttcccagctacgcgtgtaggcgggaggcgggacataaagcaagccgcccacgttgtgatccccggctgccccgggtcccgagagcaagaactgccctggcgattggctgtctagacgagcgggccaatcagcgcgcatttgctgggatgtatgtgttggagatgtcagatccgcagcatggtggagacttgcatcatctttcgtcttcagctctgggcccaagaaagaatatcttgcctatggtgggatatgaagttatttaatttcacaccgaatttcacctagacacttatagacaaccagatgcacatttcgtagtttttcttcacttttcttgttctgtttcaacaatttatcggaagattctgataattctttttgtgagtatcccaatttctcacttcagcagaaaaataaaaatccttgaacccgctatccaggtattgggaacgtcatgaagaaaagggaaaaagagattagctaaacacaatagaaaacaacatgaagatcaactctttgacacgttaatcaaaaagatgagaaggggaaggagaagaatcgtaaaagtacgcaaaaagtttggacgaacggggaattgaaccccggacctttcgcaagatcgctatcacttggatgcgaagctaagcctgttagttttcattcaaattccgttttagtgcaatgaaacttaccgaacgccatacccctagaccacacgcccatttggttgttagcccagccttgttttaggtataccaagtaactcagctaatttcacgatgcccatcaaccaagaccgacggacggtagcttgcggattcttagtcgggttttctagtcattgaccagacctgaaagattaccagacttggattccgggcgtaatattccccgaaagagagatggcaataaattcacagatctggaaagaatccagcccaatgttctgcttcctctccttactcccctcagatatggtgcgaccatgcatatgccagccctcacttcgctctcaaaccctagatagagacaaacaacttactcattcagattcttttctagctcattgagcagatatgaggataaagcaaaattatcatctatccgcgatttagtgaaaaacatgtagaccagtaacagaaacaccagttacgaatatgtgtattggccatcgatcgcagaccctagcaagacaaagccgaacgtggggttccgcttattatggtctcgctgcttaattctaaatctactgcgatgtatatcattactgaattactacctcttgacttgggagaaggctgccatgttggcctcgtgcgcttggaatcgtcgcacgggtgttgtactactgccacaggtgctgttcttccaagaacgccttcacagtgtaagtagtagaacttccggcatttgatatcatcaggtcagtggaggcctcgtcccgttcctttggatacccgcacggcaggcccattctcctcctccatgcctcgtagataaacgacggtgtttttgagtagtacttttttggatcttcccaagaaaagtaaggcgcccaccaagggaaggatggaatagatcgatgttcgataactagatggctttcttttagtaaatgagagttttgtctagcagttgaacgagggggacttgcaggcaagtgaccacgttaaattgtcaacccggatgctcagttcgtcagacggtacccattgacgcctctcttgtgtatatgctgtgagcactcgcgtcatggatttcagtcgcaattttcccagagtgtcggggttgattggcaacgcaaaaaggataaatgaatccatatacagctgacggctgctctcatccaagccgttggggatgccaccggaatactcaaatttgtacttctcgctccgcagggacacaaacgataagtggtcttggtttctcgaagaatacatgactactctgaaagcgaaagatattaggagaaacataaagtgccctctgtgcgtgttgtgtgggtgggtaggtgtgttgacagaacattaagaggtcgggtgtgtgtgggagaagtggaagttgcaaccatatcttggcagcctccctaccctagacccagtcaagaaactccaattactcgccgatgtcttttcttctaataacagagacttgaagaattagactcccttcataatagaatcgttcttagttttgatagaaaaaaagaagacctttatgcaacctagttcctgttgtaaccgtgagagagactgcaaacaacaaaccaaaccatagcgacaggagcagggcttgggattggggcttcatgtttcgttgagctgagagtatctcatactcataaactaccattgaggtcattgcacaggtgcttatcccagcaaggccttatgaacaagcctgcccgagtatctctgtcgcccgcttgaggccttagcttcaaggagcctaaggcacagcagatagataagaagcaatacgaagaccgcttcaattttggtgggtactctccctgcggttcgatcctgcctggtccatgctttcccagaaggcgcattcacctcactctttcagcatcatcgtacctgagatcattctcatctctcgtatttatgcacgtaagctgtaaaaagcgatacgagagaattcctacagtccaagtttcgatatctttggccatgcttaataaattacctcggacgacctcatgatctcggcgctgacctcgctcgcgccattcaactgtgactcccatgcccaagaccgagctgaccatccgcaagagagcaaagcacacgcgctcgaatctgggctgcggcgtctgcagaatccgacgagtgcgctgcgaccgcacgcatcccgtttgccagcgctgctccagcaccggccgcgtatgcgacgggtatgccacccagcagtcagcgtcgacaccgtctccgcaagcttcaaacgagagcagcggccacttgactgtgagacgcaccgccggcctcccgctcgcccccagggtcaaatcgtctcttcagactagctttccggagtcgctgaacgatgaggagacccgggccttccaccacttccggcagagcaccgccgccgatctcgcgggcgagtttgcgactgacttctggggccggctggtccttcaagtcggccatcgggaaccatgtgtccgccatctgaccatcgccatctcgtcactgcacgctagtctcgtcaacgatggcttcgctacctcgctctatcccattttacccgcggaggatctcagaagtcgagccgtcgctcagtacaccaaggcgttgcacctcttcaaccagcacatcgtctccaaacagggctcatcgttcgacgtgaccatgctctgctccttgctgtgcatgaccttcgagtggctgcggacaaaccacaatgccgcccttgtccacctgcggagcattctccggttggtgcgtgaatggcacgagacgagcaccggctcaacaggacgcataaccgggaaccagacctcgtactggtcgcccagcggccacctgatccgatcgacgctcttccccatgctgaggcggacaatgatggaggtgcggtcgattgtcaataacgccgacgacatggtgtttcctgccattgagccggaaacgtctgacccggacaccttcagcaacgtggtcgaggcgagagacagcctcttcgtcatcctgggagatttgtacgacctgttcgtcaccgtgggccccgcgaagcccaaaattaggccacgccaaccgtcggggcagaagagcctcactcctcaagcaagatgggatctctggtccacccgactgaagaatttcttggcccaaaacccaacacagcatagcctggccgcgtcgctgacgctgcagatctggcaaaaaaccacagggatcatgttggccgtcaaagatgtccaacaggaagtggtgttcgatatattcacggatacgttcaagaccatcgtcgacctctccacccagctgtactcgctcccgaggtctggtctctcggcagatatgtccatcgtcgccgtattatacttcaccgccaccaagtgtcgccatccggtcattcggaggagagcgctcgggctgctgacggcggcgccgcgcagagaggggatctggcagagcgagggggcggccaaagtcgcggcagagatcatggagatcgaggaaggatttgtcactggggaggtgacgaaagagacggacttggaagagagtgcgagggtgaagcaggcagtggtagacctgggggacgaagacaccacatggacgattggcatgattatgagcggcggtgggacatggcaccggggtctgcaccctccgtttgggctgcaaaactaaagtatgatagaacatagaattgaatttattagatttccattggaggaaaacaacaagtcgtctgagtgcctgcattttcttcgtgtgtcgtgcgtgatctgatgacgagattggtcctagaatgagaggccgtatcacgaggtccggccaggtgttcctgttgcgtatctgcgaccgaaatgtcccatcagctcaccaacaccttatatactacttctccatgcatttctcaaacaaaagcccctgtggtacagtggtcagcgcgctccgtgctgccttctcgcgatgtactcacactgaagacctaccgaccatataggaccctcccatgaaggtgcaccttggtggggatcttgcctgtggttggtatttcttgagtgtgagtacatcacgggacggatataaagagagacccttggttcgattccaggcaggtgtgttattcccccccttttttgccctctgttacctctgtctcttcttgccctgcaagccctcggctttgagagaacgtcttcaagtcaacgctcgcatgggccttgtggcactcgcattctagtattcgtgatttttataagtatacataaattcctcagaaacaccgatcaaaccctcaaggccatcaatattagaactttatctacttcaagatttcacctgaacacattagatcgctcttgtattagctctttagcgaaagagaaccaaaaagcctgtttttgcgcaaggaaagaagactgagtccgaaacgctttatggagacagcattcgaagtccccccctttgaatactgattaatccgttttctagctcaactggaaggagatttgtaaaaggcttgagcagcagggcaataccattccagaggatgtccttcatcccgcatattttcgccgtgaaaatctagccgctttgagtatgtcgcatacaaaatccaatcaactgcctaaagacttcttgcgagcagttcctgcattgtcgttaatcattggagggagattgtggtcgctaaacggatagtgccctccacttgcaagagaggcagacgatattctgacactgcacgccatacgaccggcaccttgtttttagtagtgcaatttccttccctccatcaccaggagataattttgattgtcgtgaacgatgaaagctaaaatcattttcgattattatggggagcctggtagagtccctcctgccttcatccataaccgaaatccaacagaattcattggctaaagataacccgcgtatccattaagagtagatatattcaaatctgccgtgttcaggcctgctcctctttagcaggaagctcccgactactttcaagaaccttcccaccctttccaccgtcaatcgacccttccgagaccggctgctcagcctcgataccatccatgacgctggcatccccaaacagagcattgatctcctcgagcttgaggcctttggtttctacgaatgtgaagtaggcgatgatgaggaagacaaagttccatgacgcgttgatgaagtagaatttccagcccaggttggccattgcgtatgccatggcgaaggaagcgagcagactaaagaaccgataacttgttagaatatatttttttctgaataagggatggagtttgctggagaaaatggtacccgaatccggcgtcgagcatgcggaaaatagcgagaccggttgtacgcagcttgaaaggagacacctcggtagggtataaactggtcattggcgtgatgccgaacgcatagaaaccctggaaaaggaaaataaccgcaatggttccgtaaatgcccgacgtgttatcactttcaccgtagcctagagtagatgggcttgtcagttattgaatttaccaagggttgaggaggcaagcgtacgcttgatgaggccaccgatcagcagaagtgtaatgaccatgccgccaacgctgacaaaggtttggatcctgcggccgaggatatccagcatgaaactgccgagtacggccacggcgaatgaccagcaattgatgacgacttggatctgcgtctgcgtggttgtgttggtgatgccggcctggttgaggattttggtaagatagaacctaagaaatgtcagaaccggtcaaagacaaagacaagtcaacatgctagacccaaaaagggaccgtatactcacgagatgacaaagttaccaaacatattaatcatagggccaaaggagcaaagaatcgcaaggcgtcgcctgtttgccttggtagcaatcatctcgcgccagggattatgcggaaactctttggcctctctcgatagggtgctcttgatctcctcaagctgctccgatcccttttggacatcgttgttgtccttcccctgcatgatgaccaaaacttcgagagcctcctcgttgcggtcgtgtgcgatgagccatcgaggcgactctggcacgaacgggacaatcacgacggctaacaggctggggacgaactgcaagagggaaggtagtcgccaggcccacgtgttctggatattctggctgccgtagttgacaatagacgaagctagactaccgatgtagaagcaggagaagaagaggccgaggagccggctgcgtctgtgaggagggagcagttcgccgagcagtgtcggggcagctccgttgctaatcgccgaacccacgccgatgatgaagcgagcaacgatgaacattgcctcgtgctgagcggccgcctgtaggatcacgccgaccacagtgacgacggaggcaatgtagatggccttgcggcggccaaagtaatccgggaccggctgcatgaggaacgcgccgaagatgccgcccatccagttggctgcgttgttgagtccttccagggcagttgtcagctcgaagtagtctgcaaaggatggcagcatcaacaatccgttcatgactgaagaatcataaccgagcgtctaagatgcagtttcggattaatggtcggaataagaaacgggtttcctttctaatgcaaaacttactgcggagttgacaattgtaactgcaagaagcaacggcaggagcaaccggtggtccgcgggaaccagtttggaaacatgttttcgctctaattgagacatcatgttcttagaggtgctttattctgagcaagttgaatcactcagtgagaaaacggtcaaaagggaaacgaagagagagcaaaagcttggtctctgagatcggagactttcaagctctggatcaagcgagtcgaggaacattttccggattttgcgaggtgaggatagtctactataaatcccaacgggtatcaatgggaattagtgattgccgagtttctattggctacggcactgctcggttgagcttatcgtctcctggctcttgacgaaagacgctatggaggtttcgacccaccccgcatatccaactggccctccatggcggggttttgccctgtcaaaatgtaaactaatgccgttcttgtaacccacccgaactcgggcgagctcgggtgggttgtttggttccatcaatgccggttaagacggcctgagtcgacccttcagggggaccaactgataagatattagacacgactcatggctggaaaatgaccggaatattcgttgaaacttggctgtgagaattctgttatatacaaacaccaaaaggagttatcagaggactcaaggcccggacccccttcctcctgtctagcaaaaccgcgactgattacgctttcaatatgccagcacggatcagagaatggccttcttgggccgagtacacttctgaatctcgagcagaggccgaagataccgatttccttaatacaaaaagtgcaataatagcccaatacggcgaagtggcgcttcggaagagttggatcaaggtgtgcgaggagctgaaaagtgtgacggatgagattgccatcaagggaaattccataattccctcttttgacaccacagaggttctcaagcatggtctgacagaggcccagaagaaagaggccaaacgagttggcgccttcgtctttcggggcacgatcccagaggctgaggcgaatgtgcactaccaagacttgagaaagttcatcaaggacaatgacgctgcaatccaaagatggcccaaagaaagcccctccatgtttattctgtacaactcaccaacacagaacgctatacgatctcaccccaatcacctcaaactgcaacgcattcttaatgagttgtggtatgactcaaccaaacgatcctctccagagccgctggtatatcttgatggcgtccgcgatagagccccggggcaggccttcttaggcttggggcctcatattgacgctggaagcctctgtcgctgggctgatcccacataccgcgaagcatacggccacatcttctccggaaccccagaggagcacgacgcctacgagctgggtatccgtcaagacgctgaccaggagttgtacaaaggcattgcgcactcgacggttttccggtctttccagggatggacagctctgacgcctaccgcccccagagagggaaccattatgctgtatcccaatgtcaaggccgtaattgcatatctgctgctgcggccgtttttcaaacccccaaaagatgcagaggatttgttggatgccgaaaaatggacatttgatgaatcttctagctggttccccggcacgttcaagacacagagccagcgcctcagccgatcgtctcatcctcacttgaggcttgaagaatgcctcgtacatgtgcccaaagtgagcgcgggtgataccgtctggtggcattctgacgtatgttttcccttatctctttggatttgatcatttcttggttttctttggtcatcgatctaacaaaaaatgtgctttagctttgccatgccgtagacactgagcaccttggcaagaacaatgcttcggttgccttcattgctgcctgcccatctacacggctcaacaaggaatacgtgaagacgcaactgactgcgacactgaatggagtcccttcacctgattactccatcgggaatgatttagacgaatcgaaattgaagggctatgttgggcttgaggggctgaatgaggaggcaaagagggcatttggtttccatctgctggatgaggcataggtattcttgatatgtttgaggactggttagattagtgacagcctgtcaagtgggtgaaataaaacatggcacatcgagatagttcaggactgaaattcaacacaatatcataataaataacctagtacagaatacaatatcaagctaaatattatagaatagtttattattctcttactattctcttcttattgtgtttagttaaaaaaggaggtccctgtctcaggcggaaagagctttggtgtgccacgttttatttcacccacttgactgtatcaatcaatgggagaatccatcagttgggtcggtatttctcactcgtccacgctcatcccttgcttatttcagctcgaagaatagcagcagcctgttgagcaactgcgctctggtctttgacttggtctagaaggtatagagcggtgttcatagaatcccaatatgcctcatcttgatcactggaagctgtctgatgctcgcgcagcaacaaggtcgcagcaacaaagacgtgaaacgacagagcccttttacaatatcctagtgattagcttgcccctggtgtcatcttggggacgaaacataccactgcttgcgcatagacgctggctggtcccaattgtgattaatccatatcacactcatcgcggacgtgacgctaattgtcttagcccaagaatatctctggggatctgcctgccactgcgcttgcagagcacgattgatccgtacccggagatgtaggaggacgacagtcacatcaaacctttgccacttgacccagggttgggcttcttccagttggcgcacgtgctcgctctccgaattatcgggtttcaaatactcagggagggtgttgataacttcggccagttcctcgtctgccttcctaacggcttcctcaactggtttgaccgcggctcggatagccacgcagaaccgatagtaggcggtggctgctctggccatgaagatgtggtaatggactggatctatatgcattttttcgtcgggagtcattgtagataccggtagagacatgtcgaagtcgacctcatcaacttgtggtatctggtaggggactcgcatcctgaaggactcaagaattagcggaagtatttcattaggatgccagaagacgagccatgccattcgacaatcataagagtccaccagagtcggcgttgaccttctgcactgagtatgtccgttgcgctagatgggggattgtgtagagaaatgctctgtgctatccggagagcgcaactccatagatggagatctaaatctgagtctccccagttgttgaaacacattccgaggatggcgaccgcctggacggagcggattgagcgtgttctcatgaaatcggagcgatggaggcagaagatggaggcgtcgtaccacatcttgcctgctctcctttgatcaaaccctatgtaacattgagcgagggacaagaagtgaagcatcgtagaaaagtaggcggtcggcttaccttgagggagaaatacatggctggcttcatcttcagccatcattaatagagcagcctatataataagagataaaattaacagactgtgaactgcaggatcagaattcagatattatgtggcttacgcataaaactgcaaagtataccgccaaccatgctggatcatagtcttccaacgcgcctcccttttcgaactctgcatagaactcgtcacactcgttttcaaacgtaggatactcgagagcgtagtgaacccacgagttccatatgcggtcaaactctactagttgctcgctacatcgacggctaggcatcatgatacttccccagtcggtcgccgtgggcgaagccggtgatgacgcggagacgagtttccatagtctcttctcgagctcatcatcgtttcccagacttcttcgaagcttttcgcctcgtgaagaaggtgagcaggagacctgctggcgcttcaacaattcaatctcgtcccgaagacgctgattctcagccctgagctcgtcatacgtgagaagatccggcgaatccgtccatctacagtgatgaatcagtatacctgagtggcggccatgtctacagaggtacacacgtcgtcacggcgccgcgtacaataaccatctctctggcgcaggcatctgcttgtcctcgcttgatacaggttgagcatggcacattcttatcgcatttgaccttgcgggatgagcatgcgaaacagctacggggtgcgcgttgggttgtccgaagcgccatggctgagttggagttggccttgatgctgtggaatgacgggaaaggtttcgatcagttactgactggaattgattggtgagtctgagggaagggacgcgagatggtcgtcccttccccgttcaaggcccgataagcgatggcgataagcgagagcccgatcgcggcgagacaaacttcaaccccgcgatttgatcaataagacgaagtatgcagtgcgattgaagatgaatgacagattggctcatcggatgcggccgacagtccggggcagtccggggaaagcagcgtgaagtcacctggtgggactcgaccgagctcaaccgaatgctcctccttctgcgaatattgtatggtgatctcatacaagccaaaaactgggccgaagtcgcccgagatcatcggccagctcctatcacaggtgcatacacatctgcctgggttccaatcaacggtcttttgccatctcactttgatctgacgctggcccctcctcgctagaaaagtcttctttgcaggtccgtttcatagagaggttcgctgaccacatccgtgcgacgccattcttcatcaccatgtctgccacactcgtcttcaaaggcgccataatccattcggaatccttgggcagcctggagatccaggacagcgcgacactgctcgtcgtagatggccgtatcagtgccttgtatcgctcgtctgacgagctccctgccaccgcaatccccgccgatgcgcaggttcatcagatcccgccaggagaattccttatccctggatttgtcgacacacacaaccacgccccccaatggccgatgcgaggtctagggcagggcttgcacatcctagactggctcgagcaggtcacgtttcccttcgaagcccgctttgccgacgccgcgtacgcccagcgaacctacgagcaaatggtggaggatttcctacgccagggaatcacaacagcctcatactacagctcccgtcatgcggatgcgacaaaggtcctggccgagacgtgtgcgaagaagggccagagggcctttgtgggcaaatgcaacatggatcgcaacgcgccagactacctacgagacacgacggcagccgcatcactcggcgagacggagcagtgcattaaccacatccgggggattcctggctgtgaaaaggaaaacgaaaaggcgctggtgaaaccagtcatcacgcctcggtttgccatctgctgcacgtccgagttgctggaggggctgggtaagatgctgaaggaggactcgtcgctcgccatgcagacgcactttaacgaggcgcagcaagaaatcgatttcaccagggtcctcttcccagaagaagcgagcaagagtgaggctgacctgtacgagaagtatgggctgctgaatcgccgctccgtcctggcacactgcacaatcatgacggactacgacaaggaaaggctgaggcagctggagtgcggtgtggcccattgccccattgccaatatgactgttggcggaggtttcatggtggcacccgtacgagattttcttcagcgagggatcaaggtcgggctgggaacggatagcggcggtgggtgggcgtcgcagatgctgatggtgatccggcagactatgattgcctcaaatgcgcaggaggtcatgtcaaagggacaggacaaggcactctcgctggaggaagcgttctatttggcgacgctgggtggtgccagggtcttgtgtcttgacgaccagattggcagttttgaggttgggaaacagtttgatgccgtctgggtagctaccacaacaggactgcactcagctatgacgccacgagaggaggacgactctctgaggacctcgtttgagaagtatatcatgacgggagatgaccgaaatgtggctcatgtgtacgtgcagggcaggcgtgtggcaggttccagagctgaatgaaacagcagaatgaaatgctaaaagaaataattgaactaaatcaaaagatgacgctagacgctaaggcaacaaaacgaagatcaacatcaatgcccatgttcaattcatgaacgacttgctctccaggattcgaagccccaaactgggtgacattgaatttgagacactgaagcaatatgctactcacctatattcgattctacgacttctattatccaattattgagggccaataacaaatattaagaggtaagtaaactgaatattgtcaatttatatcgttttatactggtgaattcctttgatcattgtaaaagctggtttgctcgtaatggcctgctgtctcatttcttctgtcaccacttgaccccagacggggcagaatagtggcccaaatacagcggctaccccgctgaatttatggacctcggcactggagcgacgttccaacctcgacgtgcagcaacatggaagcgacacatcgccatccaacccaaacagcagcctgaatgtgccagaagggtatggtgaatcgcatacaataccatgactcggcacttttccctcccgaaaaggctgcgaccaaggccagcgctcagcctctccgtggccgtgcctcccacccctcacatccaagccgttatcggtcgaccatactcctcgtccacggcttatgatgataccgtttcaaacttgcgaataggtaaggagacgcgtgtgatattccaaggattcacggggaaggcagtgagtgcgcacttcatttttccatctaccgcgtgggctgaccatcattcaggccacagccaacgctaaagacaccatcgcgtatggcaccaatattgttggcggtgtctcccctgggaaaggtggacagatccatctagaccgacctgtgttcaatacggtccgagaggtatttgcttttggcttacactcaggctctcaagactcgcaagtatcgtctaactggcgtgagtaggccatggaggccgtcaaacccgacgtctcttccgtcttcgtacccgcgcactcggcagcaaaagccatcatcgaggcaatcgaagcagaagtaccactagtggtctcagtagccgaacacatcccagtccacgatatgctgcgtgtccacgagatcctgagaacccagagccgcacccggctcgtagggcccaactgccctggcatcattgctccccaccagtgccgcgtcggcatcatgccctacctgcagtacgcgagaggctgtgtcgggatcgtttccaagtcggggacgctgagctatgaagccgtcgggtccacgaccagggtagggctgggccagagcattgtcgtgggcatgggaggggacatgttgtccggtagggatattgctctcacactcaccggatctattaccttgactcacttccatgtacaggaacgacattagcagacggattgaagctattcttcgatcatgaagagaccaaggggatcatcgtcatcggagagattggtggcgaggcagagctgaaggcagcagccttaatcaaagagtaccgacgtgcgacgccaaaccccaagcctatcatcgccatggtcgccggaaggactgcgccagaaggcaagatgatgggtcatgctggcgccttcttgtcctcgcgcgacatctctgccgaagcaaaagtgaaagctctggaagatgctggtgccgttattgtcccacatcctggtgtgatgggccagaccatgatggagcttcttggaaagagacgaaagcattcataatatactggcactcgtgctaactcggatggcaaatagcataatcaatctacgaaatgcctaaattatgctccccgtcctgactcgctttgagaaagacgtacttctattgacctgttgcgaaccgaacagccatcttggctgcctctccgaaattagcctctacatgtatcccaagcttggcttcatcgagctgtgaagcaattagcatggagataactaccaagaacatggagactcagaaatcaagtcgacataccagtttcaatccctcgaccgagtttgtgccctgcaatcgaaccacaacgggtaccttgatcggccccagctctgtcgcggcaccaatgatagactcagcaatcatcctaccatccgtgatgcctgtagcacaagaaggccacactattagcaaaccatcttcatctcataccaatcatagacaatatacttgcctccgtaaatattgacaaaaattgtggtcaccctctcatcgcgcatgatgatcccaaaaaccttcagcatcgtctccttggtagcctgcccgcccgcatccaagaaattcgcactcttgcccccgtagagcccaatggcgtcgttggtcgccatcgctagcccggcgccgttgaccacgttgcctatgttgccgtccatgcgcacgtacacgatcccgtaccgggccgcctcaatctcctcagggacatcctggctgacgtcgcgcagcgcgaagaggtccggctggcgcttggcggccgcgtcgtcgaatgtgaaggcggtgctgaggcaggtgaagctgccgtcggtggcggtgcgtgccagccgtgtgatctccaggtttgtgccgtccttgtctgtgaagattttgtacaggccgttgaggatcttggcgaggctttcggtcgaggcctgtgatggcggagagtctcttgctatgtgttttgatacacgcgacaatagttcgggagtgatgccctgggaaatggagaatgggaaggacatgacttctgggtctgtatctgtccccttggtcttgctcacaagaatgacggggaagcagttttcacggtcaatcgtcatcgctagtgaccactcctccgcaggctcgagggcttgagagacatagatttgctgcactggggggcgatgactgccatttggtccattgtctaggattctggttgccgtttgatgccctcggtccggagtgtccacagatattggagtgctggaagcattcttctgcaggctgtgcagtatttgagggctgattatacatttgccacctatgagggtccaaatcagtccaccgtccatcccaaatcgtcggggattgattagttacccagctcttcgacggcctttttagcatcttgggctgtccgcactaccttccccgacggtactggaacatcatactaaggtgagagatgagcctcaagctggtcgtggtggaggatggcaagctaagaatggccaactgagggtcaattgacctaccttttctagcaattgttgagactggtactcatgtaagctgagccgtctgatctgctgtcttggagcaaactgggacacgcgatgattgagttagagacgtctggtcactacaagggatgctttattgagaccacgaacaggagctgagaagcccagaagcctggccgagaccctcctgcaagcggtcatgattcttccttctccagcaggccggactacgcgatgcgtccagaaggggagcgatgatacgagttggtatcgtggataacgaagacgctgtacccactccggtctcgcagagggggaaaagccgaggcaattgctaccagatacggtcgcaatgccgtggagtgaccgtcgatgcacctctgcggcactggcccctgctgattgattgacttgatgatcgaagccaactttggcagaagtggtgacgaatcagaccagccacactgagccacaccaacccgcgacaagccacacacgcttggttgttggcccaagactgtcctagatagaagaaatacaaatgatttaatggagaataatcccagaatgatgaaaatttgcaacagctggacatttgaggaatattatttctcatgaataccattgatgatgccctttggtggctctgtagatatcgctgcagccatggtggcaccttgatccatcgcgacctcgatcctgttcacggccttgttcctgaacctgagatccacaactggtccgaatatccatgtcgctatctatattaaagagataagattgtttattggcgctacacggaatggcatcccgatcgaactatggataagccctccttattgtgtgccatggcttgctttccgacgagcagtatcagaagtgataaaaatggcccgattgctatcattcatctagtggaatatttgcagggttcataatctgaaagagggagccctcaagaatgataatgattgagcaagtctgaaactctcgagtctgccctgtctgatgtccttggcgaggaaccggcttaggcatccacggtgcactgctcaattgcacgctcggcgcgcatgtaatcacttttctatggcattcagagaatcacattaccattttgtgatgtaaccgtccattttgacaataaaaacgtcccagaataatctagttttattcagctctgagttggacgggaactctgtgagtgtcctgaatagctgcgtgttgcttctcgattggcctgttggttatccggatgatgtgaattgaatagaattatccacagatatgtacagagtaactccttggagtttcaccatgccctccaagctagtttaagacgaaaaatgtgagagataccagatgatgagtggaaaacatgaacttcaggtgaaacatgccaaagatcaagagacagatgtaaatcgttgtatgctagctagaccatagactgtccactacgaaacttgcagagtaaaagaggcagattggccagagagagggacttgccaccccccacggctctctgtaagtcccgtcgcagcccaagtctgcgctcccgtcgactcaacccagaccaccacattgtctgcgtgaggcgcgccctcctgctgtccaaccgtgaaagagacagctccgccctcggtatagctaaacttctcgattgtgcccgcatcaatgtttacaagcagcttcagtggtccgatgaagaccctcttcctcaccgcatcacgcggctcgaccactaccgagccatcgtctcccttactgagaatgcctccgtaagctacgagcccaaagttctcatcgtcggcgacataggttcccgagccgagagccataccgaggaatcctgggccgtaatcgcccgtaattccatcccatttcagggtgtttggccacgagtggaaggcggcgctggggaatccgtcatgattgatgttggacagggggccggtcgacccgccgtatcctacacggaggaggtagctgtcggacgggtcgtcgcggtaggccgcgaggaggacctgtgagttgaggcccgagccgtagtgatggatctggcgttcgattctcccgagctttgcgccgtaactatgtcatagttagcccttggtcctcatctaggttgcttggtacgcagctgccttacataaagtcccagtatcgccgggcgttcccgttccatccccagtgagcgatggcgggcatgaaaccaaggacactgttgatagtcttggtgacggaatctgtaaaaccgaaatatctaacgggatgaaaggttaacttgtcttctctcctatgctcgtgctcttctgtagctcacttggtccagtagtaaacaccctcttggccagtcgagtcccatgccatctcgctgccgtacgggatctcctgtgagtgccagagcgtcgcgcgcaccttcatcgccgcctcaacggcattcgcctgagacgtcagtccctcgcgcttcaggtcggccagaatctccgcaaagacagtctcgcccatcagcccgacatcattataccaaatatcgctcttcgtcatgcgaataatcgtcccctgcgcatgatcgagataccactcccagtccttgctcacaatattcgggtatgcacgcgcaacacggtacagagaccagtacgccacggcgacgtgtacgtagttgtacgcgcggtcaatgtagctcgccgactgcttgttccaggacatccaggtgccccagttgatgctcgggtcgtaggggtagtttggcatggccgccttgtcgtagtagaagatggccttcttgaccgagtagtcgctcgcctggacgccgccccagatgacggagccgacaaagtcctcgagcttagccacctcctcggcgtcgggctggagggcctgcttggcgagcgcggcgacgtaggcacccgtgccgccctcgtcgctgagtcccgcgacccaggcgcgcatgtcctgctcgacgatggcgcgcttctcgtagtcgtaggtcatgacggagggggcgcgcttgaaggggtccgaggttttgttgaagtaggcctcggtggtcaggaagctgccgaggtctgtgaggacatccgtggtgggtttggtgatgaagtagtggacggtctgagtcttaccatccgcgtacttgattgtgacgcggacacgaccccaggctgatgaggatgcagtcagggtatacttcttgtcgccagctgaggcgatcgcaaaggcgccattaggagaggtggtgatggacgacactgccgactcgctcttgagcaggagctgggcaggcaggtcgcgtgggacgatgaatccaggcacgccgaccgcgacaggtgtcccggtcttagctacggcattgtcgatatcgcggacctcctctgcgatggagaagcgcacgccaaacttggcctcctcgccagccttgagcgtctttgaggtgggcgggttccagggctccagacccttccactcattgtccgcatacgccttggtcaagacctgccactcgtagaacccttcgaacgtctggctgccgtagtaggtttccgagtaagatgtctcggcgaggtttcggtacccctccaggggcgagccgctcagaggggtgacgacgagcgacttgccggtcccccggattggattgactctgatgtatcccgcatctagaccaacgtatgggtcagagagtgagcacagcttctgcatgtcggttgcgagtcggttggtgaagatgctgttaaactcggcggggaatccaagactgccaatctcgacgggcttagtccccgtattcttgacggtgaattgcagggcgatatcctcagacaccttgagccactctcgagtgattgtaagaggacctgtaggaagcgtattggtcaggctggaggatgccaggacatctccgcttgcgccattagcagtcaccaccttccgggaagtggaagagtcggcactggtccaggtactggtgccctcctgacggtatctgaaggtaaggtccccccagtgatactgaccattgcgtgctcgaaccttaagcaagtccgagggcagaaagtcaaaggaatcgcctgcgggcttcagggatgcaaggatctgggcatctttgacgaggctgaactcgaagttggaggtcgtgaagttgaggtatccatttgccagaccaagattatcttgagcgcaagcagtgcctacgagggcgaataggagggccaggcccttgaacatcttttgggacggcatgagttgagtgtctcccctcgattgtgctggaatcgcggggttctcaaacatgtcgtatcagaccaaccctgtccttttatacgcacccaggccaaatggtaactcatcgtatcatcagttcaattaggattgtcccgcccaagacaccccggaaaatatctatcgcgagtcgtcgcccgtttggccatcattttccatttcagccgacgacatagagggtcttggcccaatacgggagctcacacggccgtcgacaaagcctattcgcacgcttcaaacccatttccaccgtcagtatggggccgcgcatgactgctatcgtatttcatcatcgactcggccagtgcctggattccggccatccgatgtaaccaaaggccccctccccggggtctcatccgttttttgagaatcgctcgggaacagcctccgagcccgggctcgattggagcgaaatttgggggttctgccttcatgagggtgtagcagaggcggcctgcctattcgagcaggggggagaaacgcgccattcagacattgccagatgcaggtgtatcaggagcctaggggttttagccgcttcagatgtctcagttaggagttggtttacgatgtgagccccgtgccgttattacctgtttagaattagaagcgatcaagcagttagtggggataaaatggacaatgaccccgtggagagagtgaaaccgcagctcgaggttaccttcagaaactattcattcttcaaactagtttgactgtcttctttgcagtcacttggccgcaatggtcaaattcagcgtgccgtcagtggtggcacttcttgctgcaccgttcctggtgaatggtctcgacttcacctctcccgggaacccaattctaggagatggctctatctactcagccgatccagctccctttgtcgttggcaatgaggtttacattctgtctggccgcgatgaggctagttccggggtaaacgatttcgtaatgaacaaatggcagattttccaggccaccagccccagcccggcaggaggctcttggaaactacacgaagacgtggcccgcccagaggggttgttttcatgggctacatctggaggcgcatacgccagtcagattgtccaaggcgccgatgggaagttctacctctacgcctgcgctcaacagagaaacggcgcctcagaccccttctccattggagtggcagtctctgatagcccgactggtcccttcaaagatgcccatccttccgggcccatcatctcgcagactgtgccatcaccaggcaactctatccacaacatcgatcctaccatcctcgtcgacggcggtcgagtgttcctctactggggctccttcggcaacctatatggctatgagctagcctctgacatgaccacggttcttgccaacagcaaagtcgtcgtcacatctctcacgggctacttcgaagctccctggctcatgaagcgaggcagcacctactacatgctctacgccgccaacaacgcgggaacaacctcagcatgcacgccaaccagctaccacgcctgcatcgcctacgggacggcctccagccccctcgggccatggacattccgcggcgtcatcctcggcgtcgtctcctccaccacctcccacccgggcgtctacaccctcggcagccagtcctacctcgtctaccacaccgccgacgccgtcaacggcggccatttccgccgcagcgtcgccttcgacctcctcaccttcgatgactccaagtccccgccgaccatcaacaaggtcacccagacaaaacgctcctccctcaccgcgccgcgcccgcccaaccgcaacatcgcgccccttgcctcgtccgtcgagtccgccaacggcacccccatccagtactggatcaaatccctcaacgacgagcgcctcctgtcgaaccccctgccgccggactactggtgctcctgggcggggacgtcctcccccaagaccaacacgctgacctacacctgggacaaggacatgcagctcaacggcgtcgccatctccttcttcaccgaccagccggccgggtccaacgtgggcgtgccccctcccgcgtcgtgggtcgcgcagtaccagaacgcggcgggctcctgggtcgacgtgagcgtcaccagctcggggggatacccaacgtcaccaacgctgacgccgccggaggtgagattccagacggtgacgacgaggaagtttagggttgtgcttcagggatcgggggggcctagtcagtatggcgctgtggggattcatgagtggtatgcgtatagccctactgcggtttgagatttgggggattatatgtagtttgtaggcagttgaatgagatatgtgtgtttcttccacggtttatttacagtgaactgtcgaaagtgtctgaaatatatacactgtatgtaacaggagggagatttttcttctacgtcgccatttatggactgagcacatattcggccacgttgccctccacacgtgggtagaattcaaaggtgaaggtgacgggcttggcaagcgaaatcacgagatcgatcgccgccgacttaaggatgacattgccgccttcgaagctccattgtccctcccaagtctataataatcattagcatttctaagaggagtagtgagaatgaaggggaaagcttacaccgcgggcttgttgcagcggtcccaagtactgagtccagtcgtcgacgaggtaagtgccatcatcggccaccatcttaacagtcgcaaggcgctccagacccttccattccactgggatgctgaggtctgagccggccaccgctttgctgctggtcgagcccaggactgggacgtcccactggacgagcgtgacgacggacgacgcgccggcagagaaatggagcgtgaaggtttccttgacaccagccgcggatgacgcatcgatatacgacgagatgatgctggacttgaaggtaatggatgacgatcccgccgtataatcgcttgctgtgagctctttcccgtcagcggcggtgatggccacgagcgtgttcccgttgaagataaacggcagctcctggtcactgactgcctcgccaacacggtggaagaggaatgcggaggtggactgctcagtagctgacccatccaccgtactatcagcaagagagttggaaaccccggccgtagagctattgatgatgctcacgactgtggggtcgcggaactcgcccgtctcgcgattaaggtggtcaagaccgttatcccataccgccacggtggcgccaatcttggtcgccgcgctcacaaagtggtcgtaccacttccacctcgctgcgctctccgtgctgcgcggcgtggcatcaaactcgcccacgtagatgggcacgccgctgaagttgccgctgacgaggcccagctcgccatccatggtcgccttgtcagcatctgaaccccagatggtcttcccccaagcagaaaaggcgaagtcatacgggctgtagtagtggatctgcagcgcccagggattcttgacctcggcgggcggcttaaaccactgagacgtcttggtggcgtcgttgttgcccccggcgagggtcacgacgcgctgcgtgttccagtcgcccgtctcggcaatggcctcgaggaagacgcggttgagctcgttgacctgcgcgccgtcctcggccgtcgccgcggggggttcgttgatgctctcgaaggcgacggtggagggcttgcaggccagcttggtgccgatctgcgtccacagggcgcggagcttggcctggatggccgtgatgtcggcgccggacttgctcacatcggcccactcccacgagtcgtggtggacattggtcacgacgagcaggtccctctcgagggcgaagtcgatcacgtcggacacgcgctgcagccaggccgagtcgacctcgtagtcgggcgcctcgctcgtgaagtggtgggtgtaggtcacggggacgcggacgctgttgaagccggcggccttgacatggtcgaatgtcgctgcaacgaccttaggattgttccacgacccctcgtcggggatggcgtcgagcgtgttgccaagattccaggctgggttcgcggccttgaggaagtcggcggccgagagggcgttgaaggtgccgttgcattgggctgatgtcctgcatgcccccaatgcacatacaagggcacccgcggtgctgactcgaagcttcatggctgctaagaatgggattcgtcttgttgcatgaggcgtttagggttcatcacgttgcctcgcgtatgagaaatggtttatatggcaaggtcggagactcctgaggagccgccccgaaatgacaccaggaaaactgcatcatctcaaacgcctggcttggcgatcgtgaacaggcaatgaggatgcttattgatggacggaaagactcttgtctccaaggggaccggagggcgttccaccgctgcaatggcatgtttagcctaacaagaaaccagcgcaatggcgaggatgctagtcggttttttcacttggctgatgaaacgagaaaagatttgcagccttgtgttttggattggccccagcacaaagcaacagcctccgagttacccaatggagagtgagtgacatcgaggaggtcatttctgtttgaagcgatgaggtggccgtttagcagcgccggtctcgatttcgccttttagccaagaaccacttatgctatgcacgtctggatgatccagaaggtcattttgactgccgcatgaatgtgtttcctttcccgaggtgatgatctgctctgtcttcggtccatcacccgccgggattcaatcgaaggtgtagggtaggacagatctggcgaagcgtgcatgaacaacttcagctttggctgccgttgccgctgcacgcatccacgggcgggccgttcatagccacagaaacaaacatcaggcactatcggataatcaatgccttggttcccggcttggcatacggcatgattctgcgggcagcatgaatgtggaaatgaaggctccacctggagcgtctcgtctttgggagttgtttgcaagcagcagcaccgccacacttccgccacaaccgtcagaacgccacagtagtcttcctctccttctctcgagcatctcgcgcccgtcaactgatgaagaatccatgagatgcgcgcgttcagtccgcattcgacgactatcatcttgcgaggatccatttctatcgcttaagacgcactcagctcgggcagcccgacgacctgcccgatgttccccaaagctgagtgtctgttgcattaggcctgcaggctgcaggtcgcgtccgccaccacctccgtcatcatgctcacagattggatgtgcgctaatcaccaacagaaatccgactgaggtgcgcagggtaggatttgaggcatgcgcataatgccctttgatgcagtcacgtagatcaagtggcgatgtcaagatcattggctatgaagttcccttaatcctgatgagagaacctacatgtagtctggatgacttctatataactgtgaaagacggcatcttctgggcgcgattttcttccaagcaggcaagaagagattaaactcacaatacctaatcttctaccacttccagcttcccaaagcctcaagcaatcatgatgcatttcaccaagaccctcctctccctcctccctgcctccctcgccctcgcgagcccaacacctcgccccggcgactccaagtccatgaggtccgacgagcctgaatggatcatcgagtctctcaagcgtgcctgcaacgacgccgatactcagtgcgactggtctttccgcatcaacacccaggacgccgccaccaccatagactgtgccttctccgtccagggcagtccggcctcccacaccaacggagctctcgtccaatgcggcgtcttttccgtccagtctggctacaacgatcaagttggagaccccttctccgtcgtgtccattgcctacgaggcccgggacctcatcatcttcccttcgtactctgaagcgcagctcgcaggtggccaggtcgtctcgcctgatcagcgctactccccgattaatataggtatcccttaatggcctggacaaattacacaggtactggtaaatttggacgcgggaggatggcacgatgggaggaaagagggcatggtgaccggttcttgagttttcatgtgcccccaatgccttttcatctcatgttgatgacgcatttattggtcaagatgtagaataaacatcgcatgttggaccgaaatgaaaaacgaaataactagacacactgaccagcaagtgcccgcgaaaaaaaggaaagaaaaaagaaatccagatcaaatggaaatgggcgctgtatgaaagcaagtacagacccaacatcttcctcgtctcactccacagaaacagtccttgcccctgaaaaaattacccttctcgcttgtgccgaggggtgaacctctgcgttgtaagctggcctacttcttctcgtatttcttcgctggataaaattcaagcttgtctttaacatgatggtattgccccaaaaggttgttaccagagtaaagtttgaatacatcgtaagacttgaagggagcattcttgtatgggtaccgcctagttgaacctttaattatgatggtttggcctcattgacacagggtgagcctactttgtatccatcttatcccagccttcgcaacgaggttcactgtcggcgagcttcttgacattctcttgcaaggccttttggagacaagaagaaccgcaactataccgaagggcttctgcggtgggtattccaggcttcccggggagttttggagacgggaagcctctgatagatgagagtgaccaggaccatggtctggtcgtgtgtgggaatggaacccgtcttggaacaagacgcaggagggaccagattctggacatgacgaattgatcgggggtgcgatttaaatcccgtggttgggaaagtagctggtaggagtagggtgagctgagttggtgaaggtagagatgttggaatggaacgatgaccgtgggaaactccgtcctatttaaacttaagatacataaaaacaattgtatcgctcacctcctagcacatatattgaagccattgaggcagtgtctgtgaagaagagaagctgacgaaggatgcaaacaagggagagagaaggatcacaacaacaaacggtatcaagttccgacagcgaccaccaatcgtctgggtgggtgggaggcacccggccaccacatacgctcctatgcagcccagacccagaaaaagatatgcagattgcgctgaggattgccattgattgagtgaatatggagagcgatcccctcgcattggcgtgtaagcagcgcagccttgccggatgaattggggaagcgatgtcctatcagtaggctgatgatgtccaagttaagaagtaccattaatgcagctgcgagttaacttcttcggcgcgtttacacacgccagcaacatggcttgcatggaaatgtcgcatgcttaatggtgtgctgaaattggtctcctgcagtagcgcggggattgaaagcacaaatcattggctttcgtggcacagaaagtccagacgggtgcgaacctgttggtagaagaaaacatcgctgttggacagaaacgacccctcaaatctttcttgctgacccgttgccacccacctgttggagactgtccactcatatattggcttcggtaatataaacctcacacggatccttactggaaagattagcaataataattcacatgcacacgctactgttccgtttcatgctggaatcatgagctcctgtcggctactgggaatgatgactgtttcccacgggtgttatcctctaagatatgctccagaagaggcggcggcagtttgaactagggagaaatttccgaagcctacagtcaaaatgccaacccgtacgctagggacctaccgtcgtgtagtatacgctagtaacggccagctaaagcgtagtgcgcgggagaaaagtacgtgtatgagcttctcgtgcgggtcagccgagatggtccgaattcatctcgtagacctgtgccctctccggcgtggaagaaaggcgcagatacggaagaagcagggcaaacaagagcacaaaggctgttcacggaaaagatatggtggagttggtcgatgagcgaggtgtcttacaagaggctagagagccaagaaccagcctcggaggctgaaaagaagggtgcgactagtgggtgttgtccacctgtcatttcgtatggtaacgcttgcggctggtctggtcggcgggtactacaccgacgagcctcaagtgcgaggctcgagccgagtgagacacccgatttcggtatgaatggcccgacacggccttcttagccctgcgcatggtcactcttctcgctactttgttgactgtcatattccgcacagcggaatctatgctgtcttacttcgagaaacgggagactgttcttgatactgggcggtacatatgttcattccggcgaccgagtttgttcctgtgctggtgacggaaagttgaggatgatgctcggctcgagtgttgtggctgtgtggatgaaggaaaatctccaaaagataatgagtgaaacaccaacccccattgacgaaggatgttaatagctcgtaacgccatttgccatttttgttgtaagagctagagagctgatagttcaatgatcgcctaacgtctgacgcatgggtgggaacagccggacagcacccgtgtgcctagataacgatgagtcacgttagctccgaaggaaaccttggtctttcgctactgtgctgagcggcgattggttgttgcccgggagattaaccaagacatgtctcataggcttgagtggcgattgccggacgcgatggttcctgattgcagaagctaaacgtcggactcatatctcagcctccaagtcgtgacgaaataacgtccaatagcaaggtgtcagatgactcaggaccatcgtaatcggtgaggttgtatgtcatggcgggaaaggcctgaagtgaggatttacagatgctggaaacggtaaatatctgttgccactctgcagacgtgactcgtgaaatcactgtctcacccggtagcagagattttcaaaatatactgccacgttcggcctagaagtgttccgttctcgatgaattgtcccatagttatccgcaaaacttcttcaagcgtgatgaatacggcatccacaccgttcatcttagacaatggtcgggaagttttgcacgagatctcgggaactgcctccactttgcccatgtcgtactgttctggggctaaaaacggccattgaagatcgtggagaagcatggtcggatctctgccgtgtcttgaggaatgaaaacgagcgtttttgccgtcagtggctttcccaattcgttcttagggtcgacacatcgggaaatctgacacggccgaagcactgatcaagtgcggctctgagctgtcatggacgctttggaatgagacattgccgaagagtgttgctctaatgcagaagtacaccgaagacgttgaagcttctgaactaggatatccaacaagatggtgtaatatataacagagctttcaagctccaacggctttcttctagcaaccaaagcaatatcttggcaagaaactaaaacgacattgttcaggtcattcaagtccaacaatttggccaaacccacagccatggccacaggaatccaatggtggaaccgggcggcgctgctgtcgctcgcgttgccatctgcagatgccttcaacttcccaggaaaagacgatatcattgttgactttgacctcaacctcagccgattatggcgacgccaagaaaacaagccagaatgcccggcatcagatttatgtataggcggggcttgcactcagtctatcgtcggcatcgacgcagcaaactgcggacgcaaaggatatgaatgcgagccaggatacatttgcgtcgccggagagtgcgtccacctcgacttcccctgcgactcgctccactgcggcgacaaagacttgcaatgcaagccaggtcaatggtgtagcgaaggcgaatgcgtctcgattgagatctttgccgacccattacattgtggccccaagaacgaagaatgcaaggccaaccagctctgtgtcaacggcatttgcattgaccttgacactattcccgaccctctacactgcggcaaggaccaaacaccttgcgacccgggaaattattgctttaacggccaatgtaggccgtttgatatcgggaccatcccacagaattgcacaatcgacaatgactgtccgttaaaaaccccttgcgagaagggagtatgtcgatccttccgcgcaggtttagatgtgaataattgtgctaaaaaagacgacaaatgcgctgctggcgagctctgcatttccgaaaaatgtacgccgctcaatattacgggcgaccctctttcatgcggcccaggctgccaaaagtgcgagcccggccaggtttgtcgttttgacaaatgtgttccaattattattagtttagaccctactcactgtggtgagggaggtccgccttgtggaaaccaagagctctgcgtatctggtgtctgcgtggatatgcgcaaccagaccgagtccaacaaactcacccgttgctcttctcccactcaggtcttcccaccacttggtgcctcgccggatggaccaccggcagtaggaccagtcccagcaccaggagttggagagcgcccatcttctgaatatggaaaccagcccagccctggcggcggctacgtgtctcctcaacctggaaaccggccgagccctggtggcgactacgtttcttctggatctgacaaccggcccagccctggtggcgagcaggcttttgttgacgactctgcaccctgtgatgaaggctgccccccgttcactggttatccaccagaaggaaatggtcatcatcccggacctcgacctggaggtgattcaggcgtccaacccggattatgctctgggcaaaaggactgtggttggaaccaagtctgccgaaacggagtatgtgtggtcaagggtggccaacctggctgctcaagtgacagcgaatgcggccctgacaaggtatgcaagaatggagcatgtgtaacctctgttggacagcctagctgttttattgacacagagtgtggccctggtaaggtgtgcaagaatggcggatgtgttgtccctgacggtcagacaagctgctctcaaaatacagactgtggctcaggccatgtctgtgtcaagggagtatgcactccttcaactggaccttccggctgtgtgagcacaaccgactgtcctgtaggacatgtctgcaaaaaggagcaatgcatccccaccattgacacctgcctggctgattccgactgtgagcctctcgaggcttgcgtcaacggaacgtgccagccttctagcataccttcaaagtgctccctcgactccgaatgcttcgccggtgaagtctgtcgcaacggcaagtgtgtcacctccaacccacagccaagctgcacgagcgacttcgactgtactggtggtcgcatttgccgaagcggaacatgcatcccaaacttctgttggaccagcactgactgcggtgatgggctttcatgtcgaaacggcacttgcttcccaactgggactaccatctgctcaagcagcgctgactgccgacctggccacacttgccaaggtggcaagtgcattccttcgacaaacccctctggctgcagcatcgacaatgattgcggtattggacaggtctgccagggcgggaaatgtatcttgagggacactatccccgtcacatgttctaaagataacgactgcttacccggaaatgtttgcagaaatgagaaatgcgttgcccagcccaattactgcgcgaaggatcccgattgcccatccaacgaggtctgtagcaacgggatctgtggaccttcaacgactccccagacctgcacgacaagcaatgactgcccctccggtcaaaagtgtcaggacaggaaatgcgttgtgccaaccacatgcttgaagaacaacgactgtgcccctaaccaagtttgcaaaaacggaatttgcgtgccgtccacaacgccacctggtggaagctgcaagaaagatgccgactgccctcctcgtcacgtttgcgaaggtggcaactgcactcttattgactcgccaggctgtaccttggatgctgactgcggtcgaggcaagaagtgtcaaaacggcacatgcgtgtcgacatcaggttgtaccatcgatgctgactgccttggtcttcagatcgaagggaaggcttgtacaggaagcctctgtctatgcatcaacaaagtctgtactcttggaacagtgccaaatcccgactgttctaatgactatgactgtgaccaaggccagtcgtgtatcggcgggaagtgtgaggtgccctccatgcctacatgctccaaggacaatgattgtagcagcagccagtcgtgtatcgatggcaaatgtcagacaccttctgggcctggatcatgcaccaagaaagacgattgcaccaatggtcaatcatgcatccatggaaagtgtgagacgccttcgggtcctggatcttgcactaaggacaatgattgcggtaatacccagtcctgcatcagcggaaagtgtcagacaccttctggacctggatcatgcaccaagaaagaagattgcacgaatgatcaatcatgcatccatggaaagtgccaaacacctgccggccccgggtcgtgctccaaggatggcgactgtggaagtggccaatcatgtatccgtggaaagtgtgaagtgactcccgaaactccatgcaccacgcgtgatgattgcggtgatgggtttatctgcggtccagccaagacttgcgttgaaattctgccttgtctcacactcacagattgcaagccaggttttgtctgtggacctgaaaagctctgcatcccgcgaacacctctctgcaagagcaatgctgactgcggtcctggatacacctgctctccacaaggcgtctgctacatcaacccaggaggcaatacttgcgcgcataactcagattgtgaagatggatcagtctgtgggccagccggcacatgtattccaggcacccagccgacatgcaagtttagccaggactgtgccaaaggcaaggtctgcagctcgacggggttctgtgtcccgggaggctctcctctttgtcagtcagatgctaattgcgatatcggcgacatctgcggtcctcttggtatttgtatcgatgttaatactgggtgtaagaatgacgctgaatgtccaactggatttaattgcagcccatctggcacgtgcgtccttgagagtgaccagacctgtcgaactggccaggattgctttaccggacaagtctgcaccccagctggtgcctgtgttccggaagggtcgcctctgtgccagtctgatgtcaactgcgacttcggcctcgtttgtggtcctcttggagtttgtattcccggaaagaatagttgcagctctaatgaggattgtggcggaggcttcatttgcggccctacaagcgaatgtgttcctgagggtcaagacacttgcaaagttgatcgagactgcggccccaaccgtaaatgcagctcaactggcgcttgcgtccctccagactcttccctttgccagactaatgccaactgcgacatcgggctcatttgtggtccgcttggaatttgtatcaaagggaataacggctgcaacattaatgatgactgtcgacaaggctttatctgtggccctgccaaggtctgtgtccctcgaggtcaagacacctgcagtgttgacctggactgcggcaatggtcgtatctgcagcccggctggcgcatgtgtccctaccggttctctagtctgcagctcgattgccaattgcgatgctggcttcatctgtagcccaaccggagtttgcatccctggaaccaacaattgcactggcgacagagactgtggcgaaggctttgtgtgcgggcctttgaagacgtgcgtccctcgaggtaatgattcctgcaaaaccaatcaagactgtggcgtcggccgcgtttgtacctcaagcggcatctgcgtcctggataattcacccgtctgctcctcgaatgttaattgcggccctggccttgtctgtggtccgctgggcacttgcgttcctggtagcaatacatgcaacctcaacatcgattgcgagacaggattcatttgcggtcccgcgaaggtttgtatccctggaggtcaagatacttgcaagtccgaccaggagtgcggaaccggccgttcttgcagcccagcaggtgtctgcgtcacctccggttctcctgattgtcgttccaacgcaaactgtgcccctggattcgtctgcggaccgcttggtacgtgtatcccaaatgacaatggcagctgcacccttgatagagactgccaggatggatatatctgtggcccatcaaagacctgtatcccttccactccagatgtttgtggtccgacccggccttgcaagattggacaggtgtgcagttccactggtgtctgtgtttccgacgactctcaactttgtgatacaaaccggaagtgtagctccggctttctctgcggaccactcggtacgtgtgtcccagataccagcggcagttgcaccgtcgaccaggactgcgctgctggattcatttgcgggcctactaagaagtgtattccgcgtggtcagcctacatgtgggactggaggacaaatctgcggagttggccaagtctgtagctctactggtgtttgtgttccggatggctctcccctatgtaccacaaacgaaaactgtgacttcggcctcatctgcggcccccttggaatctgtatcacgggaggtggtaacagctgcactgtcaaaggcgactgcccgccacgttttgaatgtggcccagccggaacctgcattcccgaagtcgaagggtcttgccagtcgaacgcaaattgtggccctggccaagtgtgcggatcgaacggtatctgcgttccggaccccaagtgcaccacggatagcgactgtggcatcgggttcatctgcggcccatccagcgtgtgtatccctaaaggtgctgatacgtgcactgcaggtggcaactgtggcattggacgtgtgtgcagccctctcggagtctgcgttccagatggctcggccttgtgccagaaggataaggactgcggccttggccagatatgtgggacgcttggtatctgtacctcggataccaccaacaactgcactttagacaaggattgcaacccgggctttgtctgtggattatcgaaaacgtgtgttccggatgccgcgggcacttgtagggggaatcgtgactgctctggaggtctcgtctgcagccctctgggagtgtgcgtcccacctggctcacctctttgccagacaggccaaaactgcgagaaggatttcatctgtggccctctaggtacttgtatcccagcacccatcgatacttgtaccggccaacaagattgcaattctggttttgtttgtggtccctcgggcatctgtatcccacagggccagccgggctgcaaatcgaaagcagactgcggacccggactcgcttgtagccccaacggggtttgtatccccgatggttcacctgtttgcagaacgaatgataattgcgctgtcggtttcatttgtggtccgctcggaatctgtatcgaagaccccttgctctgcagggccaattcagattgccgcgatgggcttgtttgtggtcctcggggcatctgcgttcccggaggaagcacggtttgcaccgttccaagcgattgcaccctcggcctcatctgtggccctctgggcatctgcatcgacattggttttacgtgcaccataaatgataattgcgatggtgtactcatctgtggcccgaacggattctgtatttctcccacctgcaacaacaaccgtggctgccaggatggattcatttgtggtccagctaatctctgtattccagagttcggaacctgccaaaacgatcaaggctgtcgggctggcttcacctgtggtgctactggaatctgcgtgcctattcctggagactgtcaaggtaacggacagtgcccggatggcctcatctgtggaccttccaacaagtgtatcccaggcggcgctctgtgtcagcttgatgcaaactgcggcactggatatttctgtggccctgcgggtttatgtatacccaaggatctcacttgccgagatgatagcacctgcgctgctggccagacctgcggtcctttggggctctgcgttgccgttcctggtctcacctgcaactcaaacaccgattgcgagactggatacacctgcagcgaaagtaagaaatgcatcttgaacttttccgggtgcagtacggacagccagtgccctgcgaatttcacttgcggagttggaggtatctgtatcccaaaggtcaatatttgccaaagcaaacaagactgtggcgccggattcctctgtgggccaaccggcctctgtattccagaagtggcactttgccagaagaatgaagactgtggcgcgggctttgcctgcagcgttggtggcctctgtcttccagagaatcttggttgccagacaaatgcaaactgcgctccagggttcgtctgtggtcctctggggctatgtacggaacccatcacccctctctgcaagaccgacggtgaatgtggtcagggctacaagtgtggcacttctggaatctgtatcccaactctgcaaagttgccagggtaatgctgaatgtggaaacagtcttatctgcagctctgctggcgtctgcatccccgactacaaggcttgcctatctgccacagactgcgataccaactcgacatgcggaccagccggactctgtattcccaagtcagtcctctgtcgcacttcaaacaactgcggccagggatttacttgcggcccagctggattctgcatccagagcaacaaggtctgccgaacaaatgccaactgcgataatgggtctatctgcggacctttcgggctctgcattccaggtaccggtctcacatgccagaacgacaacgattgcgatacgggcttcacctgtggacctctcaagctgtgcatcaagactggcccagcttgccagaacaacaatcagtgtctccccggcttcaactgcaatcccgctggaaactgcgtcccgaatgtccctggtggttgcgccggcgatgcggattgtgcccctggcaacttgtgcactctcgaccgctcgtgtgagcccaacgacctgcggtgcgcgaccaatactgactgtaaacccggctttagctgcaacagggccggcttctgctctcctacgacccttgtctgcaagtctgaccaggagtgcttgtctggcttcaagtgcagcctgtctgggcagtgtatttccgcaaatgacctgagctgcaacgtggatggcgactgccttgtgggattctcttgcggcgccaacaagtattgtattcccaaggcacctagctgcaccaaggacaacgactgccagctaggatttgcctgtgggcctttgaaaacttgtatcctgaagagcgatttggcctgcacgacaagcggtgactgcaagaacggtttcatttgtggcccaggaaaactttgtattgacccctctctccctggtcttccctgcaaagttaccggcgactgcgctcttggcttgagctgtggcccagccggatactgtgtgcccggcgacatttcaacctgcagcaagaacgagaactgcgcacagggcttgctgtgcagtttggccaatctctgcatttcacccgataagcagtgtcaagccgactcagattgccctggtgatatcctgtgtggtccgctaaatatttgcctcgacgtctatctaggctgcaagagcaacgatgagtgtgattcaaactttgtttgcggtcttgctggtctctgcatccccaagggatttacttgcgaggcggagaaagattgtgctgcaggtttcacctgtggcattggtggcctctgcattccagctaccaaggacacctgcactacctcagaggactgtgacaagggcttcacctgtggccctttgaacatctgcattcccaattcgctcagttgtggcaacaatggggattgttctccagggtttgcctgcggtccagccggcctttgcctcccaactggtgaactgacttgctctgccactcaaaaatgtcctcagggcttcaaatgtggagctgcaggtctttgcctgcctgatgatctggtctgccagactgatcgggattgcgcctctgattttacatgcggcaagggtggcatctgcgttcccaaaatcctcacctgtaagctggacaaggactgtgatgtaggcctcaagtgtggcccgattggtctttgcattactctcggggagttgacctgcaaagaaaacgcagaatgtggcgatggcttcatttgcggtttggccgggctctgtattcccaagaacttgggttgcaatacagacgccagttgccgcagcggatttgtctgcggtccagccggtctgtgtattcctcaaactcttggctgcaagtcaaagtctgattgcaacaccggattcaactgtggtcccttggggctttgtgtccctgagaacatcgggtgcagggctaattcagactgcaccggaggattcgagtgtagctcaattggaacatgcttgcctccgaactcctcgatctgcaaagccaataatgattgcagccgaggttttgtctgtggtagtgcagggctatgcgtcccagagggcttggactgcggcagttcaaactcctgcaagactggattcgtctgtggcccagcaggcctttgcgttccggacaccctcttctgttcgaagaatgaggattgcggtcaaggttttgcgtgctcaagggcgggtctttgcatcccgaactacttggtctgcagtagcgataacaattgctccaacggatttgtctgtagcctttccggtctctgtgttccttccaacgatctgaagtgcacgaccaacaacgactgtgttccaggatttgcttgcggcacggctggcctctgcgtccccgatcttagctgcaagaagaacagcgattgctctggcggccaggtatgtaggctggatggaacctgcgtgcctgatgttgggaatcttgtgtgctccaagaatgacgactgcaagcaaggcgacatctgtggtagcgcaggactctgtgttccaggaaatcttatctgcaacgcttcacagccttgccaacagggcttcacttgtggcccagccggattttgtattcctattggaaacctcttctgcaaagccaatactgactgccccaatgaccactcctgtggcccggtcggtatatgcattcccaacaatcttcgctgccagaccaagaatgattgccttactggattcgactgtagtgcatctggactttgtgttccgaccccgcttttctgtaccaagaacgaggactgcaaagccccattgacctgcggcgttgcgaatttgtgtgttgctgttaacgatgtcctttgcaagtcaaacgaggactgcctgagtggttaccgctgtggtcctgcaggaacttgccttctggacgcctttttctgttcaaatgatgttgactgtgatgaaggcgaaacatgtggaccagaatccgtttgtgtcccggataagcttctatgcaaagcggatgatgattgcattcaaggctttgtctgcggcaccgcaggaatctgtctgcccggcggcggtgtgacgtgcaatgcaaacaccagctgctcaccaggtttcaagtgtggccctctcggtgtctgcatcccttccaccttgggttgccagtcgaacagcgaatgcgcaacagggctaacttgcggccctgccggggtgtgtattcctggcgatcttctttgcaaaggggatgatgcctgctcgacgggctacttctgcggcccggccggtctttgtatccccaagttactctcttgccaaagcaacgacagttgtgagaagggccttgtctgcagtccggctgggctttgcatcccttcaggtgacttgagctgcaaatcgagccgtgattgctccggaaatctcatctgtgacttgtctggtcaatgcgtcctaggaggcggtttgacttgtcaggccgacactgattgtcttcttgggttcaactgtggtcctctcgggctttgcattaagatcgaccttggctgcaagacggatgccgactgcggccaggacaagagctgtggaccagctggtctctgcctaccaaaatctggcacatgcaaagccaacagtgactgcgcgtcaggtctcctctgtggcctgggcggattgtgcattcctgatcttgggctctcgtgtggttccaacgggaactgcgcccctggtctggtctgcagcggacagccgttaaatctctgcatcccccaagttctcaattgcaataccaacacaaaatgcagtgccggtcaggtgtgcaacgccctcggggtatgcgtgccagatctgcttggcacatgcaccaccaacgccgagtgtgaggccacatttggatgcagtctcgcagggatctgcgtccctggcatcgatcttgcttgcacgaatagcggtacgagcggcagaatttgcccaactggtttcaagtgcggcatcacgggtctttgcgtgccggacactggattcccttgcagtggtgctgagaaatcgtgtcctcgcggctacgtctgtggtgtcgcagacctgtgcgtgcccgacttgccgggtgtgaactgcagccagaactcagaatgcaacacgggtttcgtctgcaacagtgccaaactctgcattccggatctgtcgctgacgtgcaaggcggatggtgattgcccagccgacttccggtgtggaagcagcaaattgtgtgtgcccaatttcccagtcacgtgcgacgccaacgcgtcttgccctcagggcttctcgtgcaacagcgcaggcatctgcactcccacctctggctccggctgccagtcgaacaacgattgcgaaggagcagcgacttgcgtttctggattctgtgttccggagatcgtcgccacttgcaaggccaaccaggactgtgcctcgcctctcgtgtgcactctgggactctgccttccagatcttcttcccacgtgtgccaccgacagccaatgtccaaatcccttggtttgccgatcaggcacctgcatccctgactcagtccctatctgtgataccgacttgaactgtgcgcaaggcaccagctgcgttggtggtatttgcattcccaaggttcccaacacttgccgagcggatggcgattgtatcgcgcctttggcctgtatcgaaggcctatgtcttcccaagatcttgccaacatgtgatggtacagacgacttgcagtgcaaggatccgttagtatgccgacgaggagtatgtgtgcccggttcccttcctctatgcagtgtcaaccttgactgtgctcaaggctacagctgcgtggccgatatctgtatccccgacgtcgtcgatgcttgcatcgtcgatcgtgattgtcgctacgacgctctgacttgtcaactcggactttgtcttcccaagattctgccggcttgcgagcgtgacaaccagtgcaagaaccccttggtgtgcagacaaggtctctgtgttccagatgcccttcccgtctgcaacgacgaccaagattgtggagccgggaacagttgcttggcgggaatatgcatccccaaagccccgggcgcctgcagactcgacgcagattgcaagttagagtctctcgcctgcacccttggcgtttgtctcccgaaggtactgccaatttgtgatgctacacgcgagtgcaaggatccgttcgtctgcagggatggaacttgcattccgaaatcccttccagtctgccaaagtagtttacaatgcggcagtgacagcaagtgtctaggaggtgtatgtgttcccgacctggtcaaaaattgccagactgcgcaagactgcggtgcttcctctacctgtttcctaggtgtctgtctccctgagatacttccttcttgtgccactgacaacgagtgcgaggatcctctggtctgccgggttggaaagtgtgtgcccaaaacccttccactgtgcaatagcaacaccaactgcgagtcaggatacagctgcctggcggatatttgcgttccaaacgttccgaatatctgcaagatcaacaccgactgtgtcaactctctggtgtgcacccttggtctttgcctgcctcagattttgccatcatgtgagaacgatgatgggtgcagcgatccattggtctgtcgtcaaggcacttgtgttcctaaggctgtacctctttgcaataataacaatgattgcgctggggggtctagctgtgttgctgatatctgtgtcccagacctcttccagaattgcaagcaagatgaggaatgcagggactccctggtgtgcaagcttggtatatgtctaccgagaattctgcccacctgtgacggtaacaacccatgcaaaaatcccctctcatgcaaatcgggtacttgtgtgccggacacgctacctgtgtgtgagaacaacgttgaatgtggccaagaagctacatgcgtcgctggcatctgcattcccaaggtaatcaataactgcaagaccaacagtgattgtggtggttctcttgcatgcaccctcggtctttgcttaccgcagattcttccgacatgtcaagatggagctgccaacagctgtgccgatcccctcgtctgtcgacttggaacttgcgtgcccaactccatccctcgatgtggtagcaacagtgactgtgatacgggttccagttgtatcgctaatacctgcatccccgatactgtcgacccgtgcaaaacaactggtgactgtgcgggttcgctcgtgtgcaaactcggcgtttgccttccggaaatcttgccagggtgccagactgatagcaactgcgatggccagcttgtctgcagactgggaacatgcgtgccgcaaagtgtccctgtttgcagcgcgaacaacgactgtggccaaggttcaagctgcattgccaacatctgcgttcccgatctcctccagaactgcaagaattccgctcaatgcaaagattcactggtctgtaagcttggcctgtgtctccccagtattctacctcaatgtcaagcagattccgagtgtggtgactctcttgcctgccgacttggcacatgcgtgcccaagtctgtccccgtgtgcaacaacgatggcgactgcggtacaagctcaaagtgcattgctgatatttgtattcctcaattcatcacctcttgtggaaaggacgccgattgcggcaatccactcgtctgcaatcttggagtttgcattccaccgatcctaccaacatgcgatacacaatcggactgcagaagtccccttctctgccgccttggcacctgtgtgccagacttcctcccagtatgcaagagtggctcagactgccgcaatgggttcagctgcattgccgacatttgcgtccctgatcttgccgcgacatgtcagacaactcaggactgcgatggcgctctcgtctgcacgcttggtctgtgcctccctggtattcttccccattgtcagaccgacacacaatgcaccggctcccttgtctgccgatctggaacgtgtgtaccgaaaacgcttcctctctgcaatgtcaatagcgattgtgatcaaaatgccagctgtcttgctggaatctgtgttcccaatctggtccagagctgcaaggccaatggagattgttctggctcactcgtctgcactctcggtgtctgtcttcctcccgttcttcctacatgcggaaatggtgccgattgcaagagccctctggtctgcaagcaagacaaatgtgtacccgacttcgttttgtcttgtgccgtatcccgggattgcaagaccgggtcaagctgtttgggcggactttgtcttcccgaccttgtcgattcttgtcgcgatacggcggattgccagacgcctcttgtctgcaacctgggtgtctgcctgccgcaaggccttggacaatgcagtactagcatcgattgcgtcgacgaccttgtgtgcaagtcgggaacatgcctaccaagtacacttcctgtttgccaagattcgactggctgcgatcagacagagacctgcatcgccggcatctgcattcccactactcctggaacctgcaaatccaaggccgactgtgccggctctctcacctgcactcttgggctttgtcttcctgagatccttcccacttgccaagctgataatcagtgctccggctcacttgtctgtagacagagcacttgcgttcctgattcccttgccctttgcaatgttagcactgactgcaagggtcctggactcaactgtcttggaggcgtctgtgtccctcagactatcaacaagtgcctgtctgacagcgactgtggtagcgattcgctcaagtgcagccttggtctctgcctgcccactgtgctccctccatgtacgcaggacagccagtgtagggatcctttgaagtgcaggctcggactttgcgttcctcccgcgattcccgtttgcaatgtcaaagcggactgcagcgctagcgacagttgcgtaggtggaatttgtgttcccgacctggttagcagctgtacccaaaactcggagtgtcccaattcgctctcgtgtacccttggattctgtcttcctgatattctccctagttgcgacagcaatgataagtgcagcggctccttggtctgtaaactaggcacctgcgtgccgcctggtctgcctctctgcaagactgctgccgactgcgatacagatcagacttgttctggagggctctgtttccctgatgcagcgaagcaatgtcaagcccccctcgactgcggatcaggccttgtctgcaaggccggattctgtctgccaaataacactcctacttgcagcggtaatggccagtgcgcgagctccttggtctgcagattaggtttctgtgtcccagatatcttccccatctgctccacgaaggcggactgtggtcctggaaagacttgcagtaacggcgtgtgcatcccagaagccctgccaacttgtcgggcttcgagcgactgcgcaagcccactggtctgtactctgggcttctgcctcccaccagttatcgacgattgcaaaaacggacaggcatgtggaagcggatatgcctgctcacctgctggcttctgtttccccgagacactcgccacttgcgccgtagccaccgactgtggtcccaatctcacatgtagttccagtggactctgcgtcccaaatcttctgccccagtgcgatgttgctgctggacttacttgcgaggcgcctcttcaatgcacagctgggctttgtcttccgcgattctccaactcttgcaatgccaacatcgattgtggtcctggtcttgcctgcggcagcctcggtctttgcgtatccgtgagcatcagcacttgtactcagccaggcgattgtggtgccggcctgacctgcgggccattaggtctatgtgtgcccgacttggtgcctacttgcaatgccaacaagccatgcctccccggctacgcttgcagtattgctggtgtctgcgtcccatcaggtctacccacctgtgatgccagccagacatgcgcttctgggctggtttgcagcatcgctggtctgtgtctcccatcactcctcgacacatgctcgaaagatacggactgcagccccagattctcctgcaacccgtctggtttctgcgtgccaagcctgttgccaacaacatgcaccgcgcagacagattgcggcaccggctatacgtgcggagccctgggcttctgcgtacccaataacactccccagtactgcctcacgtctcttgaatgccctcctaaatccatttgcggttcgggtagcatctgtgttcctgacagctcaacctgcaccaaaaatgacgattgctcagcaaaccaaatctgcactgcgttcggagtctgcgcccctaagctgatcaacacttgcgggcccaatgagccttgctcttccggattttactgcggacctgctggtatctgtgtctcgaacaatgatcctgtcagctgtggaagcgactcccgctgccccaacggcttcatttgcggaatatcaggcctctgtactgcctccactattcaaacatgcacaggagccaacgagtgccctaccggaaagacttgcaatgctcttggcttctgcagcactgattccccgaatggccaatgcaccaagagttctgactgccaaccgggactcgggtgcggatttgggggacaatgtgtgccctcgattttgggtccttgcctcagctcaactgattgccagaccgactctacctgcggaccacttggtttctgcacggcgaatctcgctaaatgttccgcatcccaagcctgcgatgctggattcagctgtggaccggcagaaatctgtgtcccagacattctgcccacctgcgagtctacaagcaactgcgcaccgaactttgtatgtggtctcgccggcatctgtatccccaaggtcgtcgaaaagtgcgacgaaaacacgcagtgccagccaggatacatttgcggcagcggcggcaactgtattgtaaatctccctggtctctgcactaccaaggcccagtgtagccctggttacatctgtggacctggcggtctctgcactcccaatctttccggaacctgcgaggctacagacgactgtctcctcggtttcgtctgcggcgattcaagccgttgcgtggcacagcttccaggtcgatgcaagtccgataccgagtgcactggcggattattctgcagcgcagcaggcacttgcattcccaagctcacaggatcctgctcctctaatacagactgcgatgccgaccttatttgtggctctaccggcttgtgcgtgcccaagattctccctggctgtggaacaaacaccgactgcggcccagggctcctctgcggcgttgctgggctctgtgttccccagattggagttacttgcagctcttccaacccttgcggtgctggattcctctgcggtattggaggaatatgtgttcctgacattcccggagcatgcacatcaaacagcaactgccagaacgactacacctgtgggatacttggcctttgcatcccgccggggctcgacacatgcacgacatcgacagagtgtggcaccggacgcatctgtggcatcgctggaatctgtgttatcaaggctccgggagcttgtggttcaacaaatgactgttcaagtggtcttctttgcggcatcggtggtttctgcatccctcaattaagccctacatgcggctcagccagtgagtgcaagcctgacgaaatatgctcatcctcggggctctgcatccgcgatattcttggcaagtgcacttccaacaacgactgtttgcgaggattctcgtgtggaggcagcggcttctgtgttcccgatatcctgggcacttgctccagctcccagccttgcgcttcaggatttatttgctccaaggcaggcctctgtgtaccagacaacctgggtctctgcacagacagcaaggactgtgatggtggatatgagtgcacatccgcgggaatatgtctaccgggcactgcgggcttgtgcagctcgaagaatgactgctcacctggtctcgcctgcggccctgccggtatctgcttgccagacctcagcctccagtgcaggtccaacagccagtgccttcctggattccgctgtggtccttctggagtctgtatcgtcgacctccagctctcttgccagacaaacagtaactgtccccttgggggattcatctgcgggagtctgggcttctgcctgccggatcccaaacttgcttgcacaacgaatagcgagtgtgggcaaggaaagttctgcaacctcgctggaatctgtaccgccaagctcggcctcgactgcaaatccaatgatcagtgcatcgatggcttccagtgcagcgatcgcggactctgcattcccgccaccagttaccagtgcgctacatcagctgagtgtgatcgcgggtacatttgcgacgatttcaacatctgcagtctttctctcgacctcatctgcaagactaacgcggactgtaacgccggattcgcatgcggcctggccggcatctgcacacctgatctcagtgtgaccaagtgctctgcagccaacgaatgtcagcgtggattcatctgccgtctttctggaatatgcacaccggacctcaaccttatatgctcaagtagccaggattgtcagaacgggttcacctgtgggctcgggggtctctgtgtccctggagccggcctcgtctgtacccggaagagtgattgcgcccagggcttcctctgcagccaagcaggcctttgtgctccggatctcagcatcaagtgtacttccaacgacaactgcctcggtaactacatttgtggtgaaggtggcatctgcgtccccgacctcaacctcttctgctccaagaacgccgactgcgggcctggttcgatctgcggcttcggcggactctgcattcccaaccttggattgggttgtggaagcagcagtgattgccagccaggattcgcctgtggccctctgaatgtgtgcgccccaactttgaacttctcctgcaccagcgacagcaactgccagcaaggatacgtctgtggcgacttgggtgtctgcaccattgaccccaagctcaaatgcggcgtctcttcggactgtcgccgcggtttcgtctgcaacggcctcggaatctgtacccccgagcttggtcttgcctgcaaggccaatagcgagtgtcttcccggtttcgtctgtggcaatggcggaacctgccagctcggatgtgccagcagcacggattgcgaccagggcaaggtgtgcaacatcgcaggactgtgccttgaggtgagcttaggcgtctgtttgtcgatcaattcctgccccgagggctacacctgcagtttaggtggccagtgtatcccccgtctgatcccgcagtgtacgagcgacaacgactgccttggtggtcttatttgcagtggaagcatcggcagttgtgtgcagagtatcttcccaacttgcaaaggtggccagacatgccctactggatatgcctgccagggaactggcatctgtgtgcctgatctcatctcaggctgcagttccagcacacaatgcggagctggattcacatgcaacaacaacgggatctgtatcccatcgctcgggcaaggatgcaaggccaacggcgactgtgggaatgggctcgtctgcggcatcggtggtctttgcgttaataagactgacatcacctgcagcccggccaacccttgcgcagctggtttctcgtgcagcgacgccggcctctgtctgcccaatctcacttgcaacaaagacaccgactgcttcagcggcttcttttgcccggagaacggcttctgcactcccgaccttggctcttgctcttccgccaatgcctgtccccttggctttgcctgcacctcatcaggcaggtgtgagtttgatctcggcctgcgatgcgagacagacgacaactgcgcttcgggatatacctgcagcgacgccaacatctgcgtcccgtcgggtctgaagtgtacaactacggcccagtgcaagcctggatccgtgtgcaacaatctgggtatctgcaccccggatctcggattcttctgcaaggctacgtcggactgcaacactaactatgtctgcaacccggctggcgtctgcgtgcttgatctcacgctcaagtgctcgaacaacaatgactgtgcccctgggttttcatgtggtagcgacgacgtctgcgctctcgatcttggtttaacatgtggaactagcgaagattgtggtcaaggattcatttgtagcgaacttggtatttgtatcattgatattaacctgaaatgtgaagggaatggggactgcggtgctggatttatttgcagtgatcttgggttctgcatccctggtggtcaggggtgcagtgtcaacgcggaatgtaaaggagggtttgtctgcagctcctttggagtctgcgtcgctggcggcatcctctgcgatgtctccaacaagtgtcagaccggcttctcctgcagctcggccgggctttgcctgccaaacgccctgagctgcacgacatcagatcagtgcgaagatcctttcgcctgtaactcgcttggcctctgcgtgcctggaggcgtcaagtgcagaaggtcgagtgactgcaacgctggatttgagtgtacgtctggcggtgtctgtgtgctaggaaactttgtgtgcaagcagggaagcgactgtgctcccaactacagctgctccgtggctggcatctgtgtgcccaacatcggggcctcttgcaagaatgacggggagtgcagcctgcaaaactacttctgcagctccgcgggcatctgtgtgcccaagtcaggctcggcttgccaggccaagtctgactgtctgcccggtctcgtgtgtggtgacctgggcgtatgtgttccggatatcaacattggctgcaaggcccagacagactgcggcgccggattcacatgcaacaacttgggcatctgcgtcattgatctgggcctgagctgtaaaagaaattctgattgccagaatggcaatgtctgcagcattctgggtgcctgtgtccccagcacgctgccggagtgcaatgcctccaatccatgccgacaaggctacacctgtaacgaggccggcatctgcatccgcgatctcctcagcacttgtgccgacagctcaagctgtagtctgggcttcagctgtgatccacaggtgaagaagtgtctaccagacctggttcctacgtgctcgacgacaaaggcgtgtccaacaggctacagatgcaccgatccaaccgtcggtctctgtgtccccgaggtcgcagtatcctgtaaggcagattccgcctgtccgaccgggctcaagtgccttgacagcggcttctgcgtcctcgatatcttccctagtgtttgtcaaaccgcctccaactgcaagactggggagctttgcaatggcggcttctgccaagctgctcctcaagcgacatgctcagcgagcagcgactgcactctcaacgctggtgtctgtgctttgggtctctgcctttgtgtcaacggactctgtgtctctgatccgtctgtcaaggcctgcaatacagcgtcagactgcccggcaaacaatctttgccagagcggtgcctgtatcccacgaacaacatgttctgcctcagccaactgcgttgctaacattaatatatgcgctctcggcaccctgtgtctctgcgtcaacggtctgtgccttcttggaggcgaaccttccatcacctgcaatgtcaacaacccgaacgactgcggcaatgatagagtctgcgtcaacggcatatgcaaccccaaggccgttgcccagtgcaaggccagcgacgaatgtgtgggcgacctcatttgcgacctggggctttgcatccccaacatcctccccaagtgtctccttgatctcgactgcaaggacagcaccaaagtctgccagcttggccagtgtgtcgctggctgttcaagccgctccgactgccccagcggcaacagctgcactcttggacgctgcgttccagagatcgtccctacgtgcgacaacaacgatgccaactgtcccagcggccaaatctgcggcgccctcaacacctgtgtccctggctgccatacaaacactcagtgcgcccctggagaggtctgcaacactcttctcaatgcctgtctccctggtactcttgcgtgcggagtgctcaatccctgcccagctggcgagtactgctccagcggaacgtgcatcccacgctgcgagtccaacacagactgcgatctcggtctcatctgtggctccagcggtctctgtggagcttgttcttccaactcacagtgtgctcccgggcaggtgtgccaggatggaggatgccgggcctgctcagccaacggtgagtgtgccatcggcgaagtctgcagcaacggctcttgtggcgcttgctcggccactgctccatgctccggcggcaaagtctgtgtcaacggctcctgcagctcatgttcttccacctcccaatgcccggcaggccaggtctgctcggtcctgggtgcttgtggcccttgttctacagacggacaatgcccgggtggtcagatttgccggaaccaacagtgcacgggatgtacgagcaattcccagtgctctggcgccagggcttgcatcaacggatcctgctcctcgtgccgcgatttctcggactgcaacacgggtcagatttgcgccgccggtctctgcatagcctgcgtcgtgtcccttgactgtccaaacggccagatctgctctggtctcccgggagcttgtggtgcctgctcaagctcgtcacagtgccccagcggcaaggtttgccagaatggagcgtgcgtaggctgctctgatagttctcagtgttccggcgggctggtctgctcgggaggattgtgcgggacgtgcaatgacagctctcagtgcagtgacggacaagtctgcggccctctctcagtgtgtaccggatgtactttgtcttctcagtgctcgaatggccaagtatgccggggtgggaagtgcaccacttgtcaaaacaacgctgactgttccggcggcaagatctgctcttcaagtggtctctgctccgcttgctcttcaaacaacgagtgcggcagtacgcaggcctgcaacaacggcgtctgcggtgcctgcacctcgaacagtaactgcaacccaggacaggtatgctcgcttctcggtgcctgtggccaatgccagaacaacgggcagtgcgactcgggacaggtttgtgagaatggatcgtgtactacatgctcaaggacctcgcaatgcgcgactggccaggcatgcgtcaacggcaagtgtgcctcttgcactgacagcaaccagtgcaacaccgggcagatctgtgccctcggccaatgctccttctgtacactcaacaatcagtgccctacgggacaagtctgccaagatggcaaatgtggcgagtgcactgccagttcacaatgctccaacggccaggtctgcaagggcggaacatgtacagcttgcagcggcaccgcggactgttccaacggccaagtctgccgcaacaacatctgcacgacgtgtaccagccgagaccagtgtctcaacggccagatctgcaatttcctcaccagcacatgcggtgcctgcgccctcaacagcgattgtgcaaccggccaagtctgctcgaatggagcctgcggccaatgtacccaaaactctcagtgcgcttcaggtcaagcttgtgtatcgggcgtgtgtaaagcatgcacgtcctccgaccaatgcgactccaactactgctcgaacggcagatgcacagcttgtctcgccaacagcaactgcgcaaccggcgaggcgtgcatcaacaacaagtgcggccaatgttcatcaaacggcgactgctcgagcggccaggcatgcgtcaacggcgtgtgtggctcctgctcaaacaaatcccagtgcggttccagccaggcctgcgtcaacaactcctgtggtgtctgcacgagggccagccagtgcgatccagggcaaggatgcaacatctttggatcctgcggagcttgtgtgctcaattcagattgcggtgccaaccggacatgccggacggcaactggaatctgctacaacaactgcagtgcgaatacggactgtctcgccggccagtcctgccagtctggcgtctgcgggccgagctgtacagccaactcgcagtgcgcgaacaaccaagtctgcaatacctcgaacgggcagtgcgttgcgagacagtgtagcgataatgctagctgctcacttggtgttaacctgtgtttattcgctcgcctttgcgtgtgtcttaatggattatgtgttgcttaaagaatacgaggagtttggtggattttctttgtttttgttcctgtctggtgactcttgaattatgagagaatatgaggagttttaatgtatttcttttttgtttctatctgtaatttctaaagatttttatttgggttttgtctggtctagcaacaaaaaacgggttgctattaatttgagtcggtcatggatttatttggagttatataccacaacaaggtttcgctttcaggcgcttgataccctatctagaagaatttgatttttatatatctcaatgattccattgctatgaactttgaataccatgatgcacgccaagactcataagaatcgtccttagttcttgaatccttggatcaactcgtcgatggcgctactgagctgttctggctgggacagaaaggggctgtggccagtgtccaactcgcgagtttcccaagtaacaccgctgctctcaatcatgtggttttggaatacaatggggatcggagtatccttcaagcatttgacgtaggccctgcacccgtcatacgacgcatcgcggtagccatattcgtcaatatcggtcaacaacgagctcagcgagtgaggagcgagggttgagagtgtagccttggccaggtcctcgtccacgccatcatagaggaagtcgatgtcttcccgtgggtagactagatcctcttccacctgtgtccaaaagttaagaaccttgctttgatgaaaaggaggaagtgtctcacattgattaaaccgaatttgcgcaaaccttggatctttgcctcacgatccacgacaccaaatcctgcgcttgagaagagataggatgtcacccagatgattccgacaagcccgcccggttggctcttggccttgcgatccttcacatgcagctgcttgacggccggtgcggccggtgtgcctgcgtacgagtggacaatgagcacgacctggcgatccttctggaagagaggttctaggatctcatcgcggatgtacgctgcgtcatcctggactgtgacgtagggtgtaccgacgctcttgatggtatgcccgtaggtggtgtatcccttggcggtcaggagggggatgaacttgtccagacagctggcttggtgccaggcaccgggaagaaagacaatgtcgggtttaggggccatggcgatgcacttgggaaggcagttgaaatcttcaggttagcagaagcgaggcctgcttgcttctttatattcgttggcggggctatgacctgtttgttggttgggaaggatgacaacgagggtgactgactggatacgcgttagattgccagattcagatagctatttcgtacatgtaagctgacaagtatggttgcataaatggggagctctattgggatttggcattgcagtgagctctgggcttcaatgatgtttccggaattccggaagccagctcgaggagctagaaatccagcgtgtgaggtgaggatgttttttcttgctccgtcagagaggaaatgggattcaactcttataaacacagcaggaataaattttgataacactttctttgtggcggaggagtcttgagctttctttgacgcaatcaaggatcaggggttcagggtcccattcttggtaagagctaaaaagcggcggcggtttgctgccttattgggacttgcacccacaacttagatcatgaaacaggcaattcgttgcgagattttgccatggagttgtccttggtactctctgcgaaggtccgagtttctggtttattacttccagctcaataccaagtccggttggcctgaggttgagtgcttccaagatcgggcttttaaagtattgcctggtgataggcgatcagcagtcggttctgtaataagaatttattgcacatttgtatcatattaccttggtgaaactggcctgacttatagaccagccggttctacaagaatgtcagactagccaccgagagctgggaagaaagtgtagaagtcaaagccatcgagattaaatttggggacaacatcataacaattggcccagtaataacacagtatcgagtcgattattctagcatagttcatcgttccatgtttgttgtgttcagttaaagactaggcctcccgcttacatcaagagttctggtgtgctctgctttttctcagtcacttgggagactatcagcaatattcaacggcctcaatgcacacaaacaaatagctcaatccctgccggctcacgcgtatgataaaagtatcatatcataaggcttagaatgtggcaagattggagattccgcaactccgtctccacccctgaaccttcggagtccttattaccaatctggacttgctgccatggcgtcatatccagtcatcaactctgctctgcagacaaatcacccagtagccgggaattgcctaatacgggtctcaattcaatcataaaagtcgaactgcttcactcccctttgctgtgaagaatctacagttccatatccttatatacactcaagaacaagggaaaattgaaacatcaaacaccatgaagacaatcggcatattccccgcagcggggggcctcggcggcagcacgtacaaccatctcctccagcatccggaggtgcagcccgacaaggtcaccctgatcagccgaaaccctagcaagatcccagcttcatacagtgccaggggtgttcggctgcttcaggcgtcttatgagtcgacgccagccgagctggaggctgctttcgccggcatccaagtcctcttcctcatctcttaccccagccacgtacgcgactaccgcgtcaaagtacagcttccagccattgacgcagcgcataaagcaggcgtcaagcatattttctactcctcactgggtttcgccctgcctgaggagacagagtccttggctgaggtcatgcaggcgcatttggtctccgaagaacacctgcagaaacttgcggctaaggattctacgttctcttggacgagcatccgtgaagggttgtaccatgagtcttttccaatttacacctcgttttggaccttgcagaacccagtggacgagatattgatacctcatgatgggactggacccggggtaagctgggtcaagcgtgatgagctgggggaagcaagcgcctctctcatcgtgcaatatgcaaacagccctgcaccttcggcatacccatggaacaaacgccgtgtcgttctcacaggcctcaaggaatggactctcgccgacacagtaaaggtgctagggaatgccgtggggagtgacgtacgaatcaagcagattggtatcgacgaatgggtcaagctaccgcagattatcagttattttggtgaggagggaaaggccaggacttgggcaacagcttgggatgccattcgggcgggtgaaaccaagttcgtgagccccacgctggcagagatccttggaagagagcctgaggcgttcgaggtgacgattggacagttggccaaggatgcgcgggttgtctagtctacggaggtatctaaagccaaatagtacggtcatggtgaacaatacttgcaggacatttgttgttcgtctcctgtaccatttgaggtgatcccatcgcagctgtctacgtaacgaaagtattatactgtgaccagcgggcaagaaattacatttattctattaactataaactcagtacacgcccatatcattaagtcctttcactactcccgtctcacgcaccatctaccatttcaacggcgcccataatcatctggcgactgccaatgtccaggagggtactggccaccatgaggagcaccaccctgtgcaactcctccttgcagttctaccggaggcgaagccatccgatacgctggcagctctgcggacgccattggctgaggtggctgcggaggcaccatgaacgcaggcagctctgcagattgcacccggctctgctgcggtgacgagtacccagacagctctgccgagtacaccgactgttgcagctccgacggcggagacacctggcggtacgccggcagctcggacgatcgtatggtctgatggggcgacgcggacgtaatgggggagactggggagtggtcagtgggcttctcgtgcatggacgcctcgatatgggcggccctttcttcctcctttgctgatctgcggcggaggagcctgacgacgaagaatagtgcggccacggcggcgatggcaccgacgccaccgacgacgggcccggcaatccatgcctggtccttcttgtcgctgctgccgcctccgttgttggaggaggtgctgttggagttggagctatcagagtccgtgccggatttgttctccacgacatcaccgccgccgggtgtgtccgtggaagttgctgttgatgtgacggttcgggtctgcgtgacattgattgtttccactggcaccagcgagctaccggcattggagacttcgttattagattctttggtagtcgtaggtgcactatcttgttttgttgtttcggggtcaggcgccttagagctcttaggttgctcggttgtaggctctgcggacggctcgtccttgcgggttgatgtcggggggtccttcttttcggaagatgatggtggtggaggggcgctcgaggtcgtcgacgaagaggaagatagcggcggcggaggtatcgaagacgacgtggttggtcttgacgaggttgtcggctgcgatgtggtcgttggttgcgatgtagttgttggctttgaggttgtcgtcggcttcgatgttgtcgttgtgctggccttgatagttctatagaaagtcctctgtgctgccgtaccgcagccgtacattgcctttgctgacttgtcatcagtgctgtcgtagtaccagtctggactacatcccattccctgggagctaaatttgcatcatatccgtcagaattagtagcaactgccgtgtcttcagaaagacttaccatgtacgagcggttgcagagtagacgaggacgctattcgatctacaggcggtcggaacctgactctgccctgccgttccgcataaagcgtagttcgcgtttgtaaggaagatgttgccgctcgggcaggtcaccgacagatctaaaagaggagggacagtcagcatgccacttggggttttgccatcatatcttggtgtctggagccatacatgtagatccgctcaaagtgtatccaacaaagtctgcgtcattctgccgttgatacagctcggcatcgctaggaccttgcgtaagagtaaattcggctgggcggcctgcctgagccttgaagtcacgtaaaggttctgtaggaggggacgtgattgtgggatccgcgggcaagactggctgggctcgagcggtgacggcgaaagccacagccgcaattgtcaaggtagatcgcatgctggagaaagggtcttcgattttgcgatgtaaaagaaatccacgtgaactcccacgttggcacaacagcaaccgcacaccaaggcaagagtaacttggctgctacgggagaaaggacctacatatctagtttcccctccttctacttacatggttcgattactgaaaaccctgtgccagggtccaggtcgggaacgcctcttgttatggcgaaagcctaggacttgaggagcaggggtccagagcctcgtttttatatgtgaacacagcatgatgactgcatgtgcattggctcaccaatatcatatgcatcggcgactgggtcagcaaatccgcgttgagtctacagcaccagcataaggcgctattgcaactagcgggactgaaggcagacctggacttgctcaggcaccttcagccgcatccaaaccatcggtagagcatgggaccggattcagctcggcctctagccctttgctcagtcccctcattgtccccatcccaccgtcttttaccttcaagcttcgcagccgcccccgggtagctaaaaggcgactccagtctaccatgcggagtgacaatggacccgacctgaccagctcctcccgtatgacagctcgtagtgagttgtgttgtgatgatccttgcctctttctcttagttgcatcttcctaggctctcgctggccggtctagaatcagtaaatcgccagccatctgacggcaagtggcggaaggtattaccgcagcatactcgaacttaacgtgcccatgccctggtaaacgtggtctcctccctgctcaatgatcgccagtgacagattgggtccagatcgcactggagtaaggatgcccttggcgatctcagtctgggcaactctagaatccacttgccagcggccgacattaaataggtgacaatccaacaattgattgctcacaaataatcacaccatacgaaaagaaattctgtcagccccagctgaaatcgtttcttctgttatgtctgctgtgcaaccaaccagctgacccctgaacctgactattgctgctagcggcggcttttgcggaatttgtagagccaccaagaatcacactaaatcgcagggagaggctggtcactgcagcagttttgtgcatttttgtgaaggtctttgatgagatgcttacacatcttccagttttgcgaatatacggtttctctctgaataatataagatactgtagcgttttatatcggataataacgttaatatgactaattacaaccacaattcagcgtatactcttatgtcgttcgcatggaaatcgtacctttcatggcttcctatggttcacatcttggttcctgtaccagtgagtcagcaatccttcgagcagaaactctccactaccctagactcgaaccaaattccattcacgcacatctcacctaccatgaagttttcattcacgccagtcttcgcatttcaatcgcttaaacatgcatcaagagttacaatgccccgaaaaccccgagcagccacaaaatcaaaagcctcttcatccgccacaactgcttcagcagccacttcatctccatcccttcaaaatgctctactcttcgcagacgacaacgcgtttatcacatggctagaagccaaccacagcaccactccccagggaacatggctcctcatcgcgaagaagaacacatccccgccctccattacctacgaccaggccgtcgacaccgcaatctgctacggctggatcgacggccagcgcaagtccatccccgacccgggcacccacttcgcccagcgcttctccccgcgacggcccaggagcatctggtccgcccgcaacgtggccaaggtggatacgctcgccacgcaggggaggatgaagcccgctgggtgggccgaggtggatgcggccagggaggacgggcggtgggacagggcgtacgcagggccggcgacaatggagacgccggcggatttcctggaggcgttggaggggaacgaggcggcgagggagttttggggcgggttgggtcggtcggcgaggtattcgttcttgattaggattgagacggcggtgaagacggacacgagggtgaagaggatagagcagtttgtggaattgctgggggaggggaagacgttatagtgtatagcttgatgatagtcatgatattaacattttgtactagtaggaatataaaatactagatattttttggttttttggaggaaactctcaatggtattgataaattatcgttttcagcccaaggataatgatggacggtcatccagctattacctaccacccgtcctcgctgtcgccttccccttcgccttcaccctcggacagctcagcggtatcatccaaaagaccatccccagatccatcctcatcttcatcgtcgataaatgagccatactcctcgctgccgatctcgctgttgtcctcgtcagataaaccaacaggattctcctggcggtggagccgtaacctctctgctagcgatagacgagctggtggtttgtcgtcctcttcttcgtcctcgctttcggactgtgaatcgtcgtcttctggtcccttctgggtatcgtcattttcggggctagactctgaatccgaggagatcacttgtgtcccgcgtccagcacgagagcgctgtgaagcacctcgaggagcttcgtcttcttcatcggaggaaacatccacaaccgcctgggttcgaactctttttgaagtgggtccaacgtcctcgtcctctgaatcgctcacaatgcgacgctttggaatcctgaccgcgagctccatatgcccctcttcttcttcatcgtctgaagcatcttgttcaggactcgagaaccttgcaacaacagcatcactatcttcttccgctgagctgaaatttcctgggtcgggcgagccacccggagagattgggttagggatcaattcatcttccgaagatgagtggttcgagatgatctcgttgtcgtcaatgccttcgctctcgtattcggagggctcttgctcttcttcgtcttcatcgtctgagctctcttcctcgttgtccagcggaaagattccaagatcgtgcttctttaccaattcctcgaaatcttctattgctttctcaaactcaaagcaaaccataggcgccaatttcacaccacgtgacgacagagtatccgtcagccgacgactaacttggtttgagaagtcgtctatgattcggcgtgtcgtttcatcccagaacttattgagatccggccaacaatacacccactcgagatcctccccaaggccagggtgcttctcaaacgtctctaccctggcatgccgcatcatccgagagccacaccattgtatgctcctcttgctgagttcgtaatgctgcctgatgagatacaccgtctccaggttcggcagaacgcgtaccaagcgcaagatactctcgaattgctctggcgagctagggctcacgttcccgcccaaaccatccaattcgatcgcggcatggatgatattgttgcaaaagtcggcatcgtacggcgcatcgtacggctcgttcatgaccaggtcgttgaaatagacgatatctcgatctttcttgaagcgaacttcggcgtcgcccgacccggcgttgagacgaagcgtatccgggttctgacgaaggacaatcccgcgtgattcttggttcacagccgcgaccgtgcgcaaagcctccgtttggtctgaaagttccatactgtccgcaaatctccagaacggatcgcgggggggccagggtcgagctgggtgccattgtatccggatgcataatatccgagcctggcttaccaactcgggacagaacgcctcccagatgtggcgtcgcagctcaggcgggaggtcgttgaatttcgtgaacactcgtcctggctgggtttcgtcattttcatcgtcttcatgtccaagagtggatgaggattcgtcagaactttcatccgattccaccgcctccaggtctatcaactgattgaggggagagtcatcggactcgtactcggcttccgacgacgcacgatcaccttctgagtcgctagaggagtcgatgacaaacgcatggcgcgacatgtttggttattttggctattgcggcttgcaaggcaacagtgatgagctgagatgaaggttcgcaaagtgtgattttggcacgcgcttgcccatcccacgtgacagagcaatctgtcgcgaagtcacgtgcttttaaagacatttacttacgtcatcttctcacccgttattcgatgtaccaagctcaacattcgcactaataaacaaaaggtttggttccgtaggggaaaacaagaaaaaatgttgctatattgggaatccccaaactagctattgggaaagttcttctcatgattagcactcttgatgtgatccaattgcactggtcatacgaagtaatactagattgcttcgttcatggctgtagggtagaccttgcttagtagagtgatgaattgtggcgcgtcaggtaagacaagtaggaagaacacgtgaccacccttctcatcaccaatcgaatgagaatacctaaataaggacttggccctccctagataatagaaacttaagtgttcaattgcaccctcgtgaatatgtgacaagctgtgacaatagtgctgaattaatttcttcagaggtttggagagaaagttcaagccaaaccatcctctgacatctagatgatagtagctatattggttaatctagattacttctgttctcaattcccgcacatttccagataaaaaaaaaaatatctcccttagtatccgctgtgctggaattagacgattggcgagcttggtcgccctacagtgttacgatcagatggcctgagagtctccttttccacacagaactagacgatcaatgagcaaaatcttgctaataaaatgccattgactaattttcaacttaattgtccaacttggactaactctggctcggcgatttgacttgggctagctttgtgtagtgttgtttcatgaccattacgtgaagaaaagatatattcagacacttgagcgtaatagtacaaaggactagaaagacaattctagaaaataaagttaatggctaagtcgaccggcctccaaaccacactgggctcgctggctaccgagaacccaaccgcaacccttctttgcgggggtacacttttgcggttgagcaatattagttggcgtttgttgttgtcttggataggaatgttattgtcttacctttgcgttagcctcgcaggcaactctgtgccctgtgttaaggttgcagaatcctggtccctgtccctttggctgaaccacacaggtctagaacatggcacgcccagaaccccgagtattgaatttcaacagaatatcagcacaatatcaaaacaagtaattagtaatagatataatatcaagctgaatactataaaataatgcttatttattttcttattatcatattattgagttccctgacttacgtgaacagacctttggtatgcatgttttatgtcactcgcttggtaggtcaccagagtcgctgctgtgtggagcagggcctttttttcactttctcttcaaatcgaaggcggtggtggcagtggtgatggcagaatccccaatctcatcatctcttcaggtcgtttcttcaagtcgtttcttctctgtttcttccactgtagcaagtagaaagccagttttaatttctcgattccagatatcacattcccggtttccaatttcccaatttcaaaggcattatatcacaatggtcgaagattgggtcaatcagtttggatatggagtcattgttgctgcgggacttggcgcccccgcggtttatgctaccgcctggctaggctggaggaagcattgggacgatcatgagcttgccgtgaggaaggatatgcgggagaaagaggaagccggcgagtgttcatggctcttcgattgttaaccctctctaatttggaatcggattagacgagaagaaggctaagaaagccgctgagaaggttgatcaagatgtggtcctgagaggtgttgccgaggaggcaaggaagctagaggtatacacgcagcaagtgaggtgaatgcgttgtcagccgacgccagccgtattggctacattctgctcgtgccacccaaaaggaccatctcttcaatttgttcgttcccttcgttggcttctagagttctgtcctctgtgccgaatgattctgagctcccggcggaagtcacgcaactgacgttcggcgtgctccgcgcgaagtacagcaatgtcttcgctccgttcaacctcttgggcgcgctgttcggctcgttcggcgcgctgttgagcgccttgttcgcgcagtctaactctctccatctcgttcccgagatggatcacttgcttccgagatggatcctttgcttcctgtggttgtactccagacaaggctcgttcccttccttgctcctcgagggctagtcacggactcacggccgcagtagaatgtggcaagtgggtgacattgaaattgagacactcaaacattatgctgcttattctcgagtctgcgaccgatatgatcagattattgagtggtaataagatatacttcagagataatacagcatatgttgtcaccttattccatttcatactactggatttcatcttagaaagtagtctggctatgacctttcctccattaggtgtctcatttctcttgtcacccacttctgtggctaatacggctggcgtcggcttacaacgcattcacctccgtagcgcgtctggatttatcaactagagcagatttagaaaagaggagcctgtgggatcatatctcacattatggggattcacgttatgcatttcccctgtctagggcatctggcacagatcggtcccctctccgacgtggttgctgggcgtcaagacgaacttggcacagacagtattccacacaattatctccctgccttcccaaattgtatcgaagcaactagacatggtcagcgagacaacaagagataccatcgccggtgcagcgggtggtgttgctcaggttctcatcggtaggcatcccgtcaccgggccgtatagctgttgctctgaagttaaccatgtatcttaggccaaccgttcggtttgttctgccagaataattttttttacgtattttcacctgacagatcgcctattttctaatagacatcgtcaaggtccgactccaaaccagtggaggaagtggcctcgcggtcgcgcgaaatatttggctcaaagaggggccattggctttctacaaagtgaggagaaccgttagaaacctgtcttgtataaacatacggaactgacatcaactagggatctcttccgccgttaatcggtatcagcatctgcgtgagtgtgcaattcttgtgacccaaaatatccgatagatggagattgacaatcaggtaggggagcattcaatttggagctttccagtactttcggcagctgttccagaaccgccaaagcagagctgggaattctaaagattcgttgccgatatggcagttattcgtggcgggtggaggagctggcttggccaacagcgtcatatctggccctgttgagcacatcagaatccgtctccagactcagccgtctggcagcggaaagctatacaatgggcctatagactgcgcccgcaagatctaccaacaagctggcattgctggtattttccgaggccaagttgctacgatggttcgcgagttctacggctttggcgcctggttcgcgtcctacgaagtatttgtgagccttctgaccaagatggataacaaatctcgctccgaacttccgagttggaagatcgcaatttgcggtgggcttgcaggggaggtgaattggcttttagcgaatccatttgatgtcatcaagagcaggctgcagagcgatggctttggagagggaagaaagtacaagaatacacgagatgcagtgttgaagacatggaagattcagggatttggaggattcatggaaggactgggcccatccttacttcgtgcgctaccagtgtctgctggcatttttgctacgtgagtttatctttcttactatcttgttcgtgaagctgactttatttttagggttgaaatcgttcgaacaatcattggatagaatacataagcgggctaaaatgtttagacatagaatgaattatacatgaatgatcgtacaaaaaaaagaacgaggcttcttgctgtctctacgtatctttgaattggcttgtgagatcccatgtgatgattttgaggctacattcaacctacatttttgagcatgatggcttccagtgaattgccactttcgtactcgcttccctatctcttcctcttgagaccaaaactagtttaggttaatatcaagggcgtagatgaagaacgtgcagcgtcgggcgaattcccgtgagtgcgtatcaagatagtcatcaggtgggcaccattatggcgactgacttgcaagcgtttctcctaatctgttgtcgggactgggcccgcatagtaacttccccacaagcaggggacggtgtgcgttcatgtgaggaaacgctagatagacccttgagcggcagcactagaacaagtgaatgttctagccgcctcaggtctggggtggtcatgggaccaaagcatggagttgcttgcgccagccgcttgtcatctcgatgagacagcccaaacaaacgagtcgggagtggggccgagtcagcgtcaactatcaccaacttgctactcggacgagcaacatcatacgtttgttgactttgatcatgttatggattccgaggtcggataatagcctgtccttttggatttatcgagctcttggtggcttcacttatatacggccttaatccaatgggcaagcgttagttacatgtagcaaatggatcagcaacacctttggacattagtctcaaacaacacaatctgaaattccaacatcagattctccatcatgcctctttcaaagtccagtgaaatagtcattgtcggtggtggggcattcggcctgtccacagctctgcatctcacgcaggccggctttaccaacatctctatctacgagcaagacgaccaaatcccccctcgctattctgcagccaatgatctgaacaagattgttagagcagagtatgaggacccattctggacagaattgactatcgtgcgtatctcactgtacccaccacacttgtccgagatagagtgctaatatgatatacgtgcagcaagccattgcagcatggaagacaccattctttgccccgcacttccaccaaactgggttcatccattgtgtatccaaggacgcaccccaggaggcttctgctaccctcaacaggttccgggtggcagcggatgctcacccggaaatgaaggaccatgttgaacctttcaccaaagacggggacatccagaagcgcttctggcagtaccaaggatctttccctggctggacaggatacctcaacggctacgacggatacgctcactctggcaatgcactggcctcggcttaccgcgctgcgcaggccagcggcgtgaggttcttccttggctcgcagggttccgtgtcacgcatcgtctatggaaccgcatctggggccaggaaggcaacagggatcgagctggctgacgggcaagtccgtgccgctgacctggtcattgttgctgtcggcgccgcggccacaaagctggtccccgagatcggaacccaagtcgttgccaagtcctggtccgtcgctcacgtccatctctcagacgaggaggtttctgcccttcgcggcatccccatcacctacgctcgtgaccttggtttctactttgagcccgacccgaagacaaacctgctcaaaatttgccccatgggaggtggctatgtaaacacagaccccgagaccggcttctctcatgcgcccgccaatttgtatgacagtgccttcgtcccgccccatgatgaggcaaagatgcgcaagcttcttgctgatactcttccatacctggccgatcggccgcttgtgaagaaatccctctgctggtttgccgacacccagaactcagacttcatcattgattacgtccctgacacatctgattctctcgtcttgttgacaggtgactcaggccacggcttcaagttcttccccatatttggtacatgggtcaagactctcttggagaagggtgagcagtcaattgctagatggcagtggaaggaccccaatgccagcgctgaggacaagaactggggaggagctgtgagctggcgcctgggagagactaaggagttcgcggagattagacccaccccgaagtctagaatctagatctgccgactaatgatggatatcataacttcgatagataaaatatgctgtttttgcttttctgcatgagattttagtatgctaactaatacgtggctgtcacaaagagttgtttatcctgtttaggcaggaattttagctagactgtagcggttcttgacaaataaatatccttttctcgagctacacaatgccgaaggtaaactttgaagtcctaaagaatttgcctctgtttggttttgttgcgtgaagcagggctggccatgaaaacccggagtttggcatgcacggatgcatgaatgtacatcgttatcacacagcactgaagccgaaattgcaaatttgcctcatttttttacgttatgaggttggattgagattattctactcagatgatctaatattggtatttctactctacggctcggatacccctaaatttgaggcttgaggcacccctttcatccacacctcgggttctctcttcccacgcgctagaagctccttgcctgaatgtagtttgaaacagagcaaatagattcctgtatgtaatatcggtggcggtcccggggcagatacgtaaccgttatcggatggcaatagtcacgcgtacacaccaaagtcaccccttggatctagacacccctctgggagataacaaagatctgatctagcctcccttggaacatgcggcgtcaacaaagtattgatttaggcaccctaatactaccccatgatctttacaatccataccccgcatcgagattggcctggaataggtggaagtggccacgggtatttacccgatattggcttgacagtcgaaagcatattgattgaagcaggttataagtcaaaagcaccatcttcggacttggacgaaaaccaacccaagactttgtcacataactaatataccccaaaaatggtcacttcacgccgtttgattcaacccaaggtgtgcagggacgctgtccacggtgttcgccacctctctaccacacagcttgtccgaagcccaccgcacccttcgtcggcttcggtatcttcagctgtatcttcctctgctaccacatccacaaagtcccctttgtcagtcttgccaactggcgtacttctcagatcattcttcatcaacgcggtctcctcaagaccgtaccttctttccccatccctttacatcctttccaaaatctccaaatctaaaagcggcgtcattctcaacgtcgaccgaaatccattactacgatggattatgaagaataccttctacaagcagttctgcgccggcgagagcgggcgtgagactcgctctactatggacctgctgcagaaccttggcttccgcggcacgattctcacctacgccaaggaaactgtcttcgacttccactccaacagtagcttcggccagggcgtctccaactccgcgaaggagggcgagaactgccctagcattgaggcctggagaactggaaacatggaaaccgtcaaccttctccaggagggagatcagttggcaatgaagtatgtatctccttttcatcgcccggtgccttaaacaatcactaacagcaatgtgcagactttctggagctggaccccgagtcaccaacgcatttgcagagggcaaggcgccccctcaacagtttctcgatgctctcgaggagatctgctcaaactgcaacgcccgcaaagcccaaatcctcgtcgacgccgagtcccagcaattccaatggggcatcatgcgcgtcacaatcgatctcatgcgaaagtacaacaccaccgacaaggctttgatcttcaatacctaccaggcatatctcaagagcacacccagcaccctccgcacccacatgcagactgccctcgatgaaggattcactctcggcgtcaaggtggtccgtggcgcgtacatggcctcggacccccgcggtctcatccacgacaccaaggagaacaccgatgacgcctacaacgccatcgcccagggcttcctgaagcagcagtacgagggcttcggagttaatggacgtgccttccccgcctccaacctgttcctggccagccacaacaagttcagtctggtggaggcgtacaagacgcacatgtcccagaagcgacagggcctccccacggtgcccgtcggcttcgcccagctgcacggcatgtccgacgacgtgagcttcgagcttctcaagatgaaggccagcgacgccggcctggagacgcccgacatctacaagtgctccacctggggcacgctcaaggagtgcatggcatacctcatgcggcgtgcggcggagaacagagacgcggtggggaggactgtggacgagtacgcggcactcaagacggagctgggcaggcggatgggactgtctgcctgattattttagtttcttagtactaggtttgggagagcatatctcacactacggaggcgctacgtagcaaaattgatgatctatgaccctgcattttgacttgcgtgcctttcctatttgagtgatgtggttgcaaaccgtgcatatacatagataaggagagggggcgtgtgagtcgtctctcgatccagggagtgacgagtgacacgtgggagaggtgatgggagtgtcttgatgcagatcggcaacggcctccgattcgtcagtgttgttgcaggaacccctgggcccttgggaagatcccaggagccactcgcacttctttgtctatgtccccgcatgtgtctctaaatcagtctaagcgacaggatctcaactaaggtagtcaacgtgccaaactgctagccggtcggcgcggggtggcaggaaggctgtcactgacttgccacggatggggcccgtgatagcactacggatcggatccggggccgatgagcagtgtgaatgatccctggtggcggcatggggagaagaggacagagcactaatgcagcatcgggagcatttcccatgaatttggatccgagaccggtctcggccagcgtcccggcctcgagatgctgctgccggcctcgatcgatctcgggttggagataaactcaaatggataaaagagagacgaatcaagggcttttgggcattcctgctctgtatcaggcactcgacccttcacacaacaacagtaattcagaatggccatcacacgagttctcggatccaagttcagcctcgctacacgaactgccccccgtgggttggctcgtgtaggagctgtctctgctctgcagatccgaagcaagactacgaccacgatgccattcagagtccccgacgagaggaacgagcccaatgtgagtttttcccatgacgaaccaattcgttcaatgatgtatgttactgacattttaattcagcctctctacaagaagggatcgcctgagcgcctcgaggttgagaaggctctcaagaagctccgctctgagctgcccgtcaagtctgagctgtacttcaacggcgcattccagcaggctcccaagtctgaggaccaggtcatgccctctgagcatggcaccaccttcaccaactaccccctggcatccaaggagcaggtctccgaggctatcgagctggctctccaggccaagaagggctgggaagagatgcccttcgtcgacaaggtcgccatcttccagcgcgctgctgagcttgctactactgaataccgctatgagctcatcgccgccaccatgctcggacagggaaagaatgtctggcagggtgagattgacgccgctgctgagttggccgacttcttccgcctgaactgcaactacgctgcccagatcctcgagagacagcacgaccgtggctctgacggtatctggtctcgtcttgactggcgccccattgaaggtttcgtctacgccgtctcccccttcaacttcactgctattggtggtaacctgatctccggccctgctctgatgggcaacgtcgtcctctggaagccttctcagtacaacatctacgcctctcagatcgtctacaagatcctcctcgaggccggtctccctcccaacgtcatccagttcgttcccggtgatgcccaggaagtgaccgacattgttctcaagcacaaggactttggtggtctcaacttcgtcggttcctctgacgttttccgcaacatctacaagcgtattggtgaaggcatcggcaacaagacctacaaagatttcccccgcattgtcggcgagacctccggcaagaacttccacctcatccataagaccgccgacatcgagtctgccgtcaaccacaccatccgcggctccttcgagtaccagggccagaagtgctccgccacctcgcgcgtctacctccccgagtcccgcgccgaggagttcctcacccagctcaaggccggcgtcgagaagatcaccatcggcagccccgacaaggacatggaggcgttcatgggccccgtcatccacaagcactccttcaacaagatcaagcgcatcatcgacgagaccaacaaggaccccagcgccaagctcatcatcggcggcacctacgacggctccgtcggctactacgtcaagcccaccgtctaccaggtcgactccccccagcacaagctcttcaatgaggagatcttcggccccgtcctcgccgtccacgtctaccccgacgccgagtggactaacatcctcaagcacgtcgacgaggctggtggcggtctcgccctgaccggtgccgtcttcgcccgcgaccgcgccgtcatccgccaggccgaggatactctccgatactccgccggcaacttctacatcagtatgttaccctttatttctccccattctgatagtgtattaacctaatttctctcagactgcaagaccacagccgccgtcatcggccaacaatccttcggcggcgcccgctccagcggcacaaacgacaaggccggcagcgccgaccccctgcggcggttcgccagccccaggctgatcaaggaggagttcttccgccagacgggtttcacctaccccagcaacgagtcatgagtcgaagtatatagtgtatcatatggggggtatcgctctggattagttagatagctcaaagaaattttggttcggctactggtttttgggacgggtcaataacgattacaagaaaatgggatcaagaaattagaaatgaacattttatactttatgatatggatttctgtggtttgttgatttggttattattgagttgaagtcaggatcaaaagactcaaggaccctatgactttcttttgaatcaaataatgcaaggaagacgatccgtattgataaaataacgaccattaagccaaaatcaacagattaaaggagtagaacattgatttaacgtaggcattaaggtatgatgtgccgtaaactattgtaatattcagccagggtctaagtgtgcatgtatcacactccaatgtctgactgggtccgggttagtaactctcattaatttattctccgtaattgcgttgtattctcgctatctaatccttgccggtgatgtaatctatttatataacaatcaaatgccgttttttaaagtgcgatatttcccggctgcgctgatcacatccgatgtctaccgcgatggagccatctcggcccgtgctatgcacttccctgacccggtccccttcacagtctcggaaggcttacagatccgaaaataatttctggaaatacggccttgcctccatgtttgctacacagccgatgccgaatgccgggatgatcctcaggcaccgcaacacggtcaccgacggcaggtctttccgtatttgcgatgccctggtgagaagtgggatatgttgctggcggttgtataagtccaatcctagtaaatgtactggcgacgccgccaattgtgagaaaatgggcactgtgagctgactgacaacggccttagtatgggggttggcagccaggtgatccggtatcagggaggataccgctggcgccagagtgaaagaaccgaatatggtcaacgcatctcggactagaaacgtagcggtgactgatttcggtgttttggggatgatggaggtgatttttttgttgggatctacggcagcgaagagccgggcgtagctcacgtccttccacactcccagaggcacgtttaccaacatagtggtgaagaaggtgacggttccgactgcggccatcttgaactcatcgcccagcgtctcggtgccgttggcaacgacgtatgtaccagcatacaaagcccataccaatccgaaagggcggccgaataggaaacgtgcagggtgagtgagcgcggcaatgccattgcgacgcattccagtcagcagaggttgattgatggaaattttttcaaccatagacctgtgaaaccttgttagcacttcatgttgcttgaattcttgattctagaatagataagcacaacaatgtgcccgaagagagtacacacacctatcaatgacggccacgatgggcgatatcaacgtggcagacacgaatccagcaacggcatcgccggccaaggccctgaagagccgactgctccttgtggaatcatgttgggtgtctgccgtagacatgctaagtttgtgatgtccttggtatcaggtctgaatggtgcagcttaaccagaacttagtccattttcctctggtcaacgcaattgtcccgcgactagcagcttcaaccagggcaaaggactttcaaatgcacagcattgccacatgatgtagccattgccggcggaatgccaactagatcgtctatactggcacttacagatcaaggcgcgtgctacggattgctggtcagtgtcgggatacttcccgatatttgacagcttccgtagccggagacacagatctgggattcagggtccacctgctgtgcctcctcccgcccctgggcgtgatgcgatgcagacaagggcatctagcccgtcatgcagcgcttggtgtgctttttcctgaatgggacagatcgctatcgccttcgccctgttatcgtgggggacagattctgcggggaagccttcgagctacgggcggtgcttccgggaggtggtggattcggtctcatgattcattctgaggctggcgtagaagcatatcgcgaaaagatacatcggaaggcatccggcgactatgaagatagggaagaagggtctcgacaagcattgggctctccactaccccagccttcgtttgatagcggcggcaccgtcgactgagatgggaatgctagttcgagcctgtcgacgatcagtggtcgtggatggcaacggggatggatttaggtttattagccgccttggtcaggatttggggctcgaacggcctgcatgtctctccttgactgatgggcagcaggtaccagatgacgagtcaggtcgtggaggtgaaggagggatgtgccagaagcgagtgtccagaaacgagagatagcgagttcggctagcgctggcgattcgagataaggcctgatcaggactagcgctgcgctgcatgtgaggaaggctgaagcgatagtgaggggaagcgagcgctagaagccagcggccagccaatggattagtgggctttaggtctcgaattacagcatatcaacgcctggcccccagttatccccacagagcgtgctcactccactatcaacgtcactccacaggcaaaccaaaccactcatctcatctggccacaaacctcgccgtatcagcagccagccacccgccgcttctcccagcaccgcaagacccttcctcgacagagctgatctggcctggcctcgcttgtcctcccgtgattctcgctgcccgatcgtgtccagcccttcatgaccgagagaacctctggacgaggccgggtctccaaacgatccgacaacgcgttcgtcaccccagcccagtcccaaagtttgctgaaattagagagtacccaccggctgactcactgatcttctgtggaacgacaacagttgctcgagatgtcgcaagcaaaagatcaaatgctcaggctcgcacccttgcgacgcctgtcagaagcgcaaggtttcgtgcgagtttgacagccttgaccaaaaggttctcgtcactagagggtatgttgcctaagccttcaactcttcgacttggtctcgtctggtgttcttgaactggtgattctgattgctcctggccagatatctgctgcagctgcagagacaaaccaagaaagagaagcaggatggcttccctgactatgctaccccggcatctgcggacctgcatcctgggcaggatagcatcaatgttaatgaagattgtatgtatatccccttcattggactcctctatgaagactctcatatcacctaataagtggttaacaaactaacacgctatagcctcagaattggctacccgcaggccagtatctgagactcgcagctccgagagtcgagaaaatctggatcccatcgcctcaacactcacgaaccctatgtctaccggcaaatcgaaattcatgaagtcagccgaaggaagaatatgtgagatacaatgcccctgcttctattccgccacacctaggccactaaccttttcctgctcaagtttatcttggcacgtcttccacatggtcattcagtcgccggatcatgagcctgacccatgaatatgttcatggaacccctatagcaccgaccactctcctctttgatggttcagcatacgacctgggctgggacggcgctcgagtgaatcatccattcgaccacgcgcctcttcccacccttgatcacgccatcttcctcatcaacaacgtcaagttccactgcagccagctattccacctatttgacgaggagtccttcatgaagtatctctatgactactactctcacccaacccccaaaactggcacaccagatttgcagtttatccaccttctggtcattctggcaatgggcaaagccctcggaggcagcacttttcaatccgacatcccacctgggtccgaatattttgtcatggctattcagcgcatgcccagcttccacgctctgtttggacaacccatcttgctaacagaggttttgtgctgtattgccctatactttcagtgtctggatcacaggcacgcgtctcatgcctttgtaagtaatttaaattcttcattggcaattccattgcttacacggtgtgcttagattggggaagcgattcgaatggcgttgggtcaaggaatgcacacagatatgccacaggacgagttaggagcggatgttgtcgagcgaagtcgcaaggcgtggtggactgcgtacctgctggacaggcagatgacctccttgatgggtgttccacagtcaatccatgacgacgatgtccattcacagctaccggactaccctgattctcaacaacggaggacggcgctggccatgcagatccgcctgtctcgaacaatgtgcgccatcaacaaaggtaaggaagaaataacacgccgcgatcctcatcgagtggttcgtgctgacaagtttactaggcgtgtacgggaccgacggtagactgaacaaacgctttttgatcaagacaaaggaggtcttgtctaatattgccgatttgactgatgaattacaacaaaagttccccatgcaggccaacgggccgttcagtacaatctcaaggacttccggctatctccatctcctttatcatcaggtaagccatctctctctagttcttcacaactgttacgctaactttatctcgacagtgcatcatccttgccacgcgcccactgctattttgcttcatgaagattcaattcgaatctcccgacacgtatttggagagccttaactcatctcaaacggttcgaagtctgattaagatgtgcatcgactcttcccaacaatgcatcaagctccttgattgtctgctcagtcaaggtctactcggtatgaataacccatctatctttcattggtttgatccacacccggaaattacttactaacactttagaagcttcgtttctcaccatcgaccttgaccctctattcgcctctagccttaacctcctcatcgccccggcgatcgactacagctggatgtccgagaccaccatttggcgagaacgagcgtatgccatcctgaacgagatgattggaagagggaatcggatagcgaaataccgactagcggaacttgagcagctggcagacatgctcagccacctcccccaggaaagttctccacagacgtacgtgggcagcgacctagaggcagctgcagcagtccctgtgatacgccagcttctggttggaccacccccgatacttgcgcccgggatgccaccgctggctgcagcgcacatggatgataccgatgatctgacggcagggatacctaatctggaggaatgctatatggaggaatggctatcgccagggcagatcacggccatggccaactcgattgggaacagcgattcggaatggctttctaatacgatgacggagcatgatatcttttagaaacggcgattggctgggagtttggtgatcggtcaagtgcatttgggcggcgtggaaagattctgatgagcgtatgcgtaaatatatcttcgatttattggttcaatagatggctttatctaggccaagtaaaatgataaattaatgagttccatgtttgttacaataaccctccggattattttccttccactgtcaaacgtccagatagttttttatgaatagatgctgttcaacggccgcgtggaaaacgtgtcgggacttgattgcaagttggacgaactttccataggtaggcaacatgaggtaagccgaagaggcacttggacatcacaacaacagacgacatgttattctccacaatatgtcgctacttcaccatggccatcttaggaggtaatcgcctccagcctccagctgggcgcctattgcgcggacttcagcggtttccttctgctgaattgcctctgccaaccgatgttcaagggattgaatgagctcttcggcatcttcccagcgctggttggctcttcttgcggactcgaaggcgagtcggtcgtgctcggcggcttcttgaagaacgcctctgacggcccttccctgctcgagggctgccacatgtccctcctccctggcgttttccaggccgccatctgccgcaagcttcttggcctctctctcggcattcttcgcctctaatccagttccaagttagtgggggtttagcaatcaaggggtcatgaacactcacccgtttccgcttcctcccgagcgtccttcttctcaccaagcctcatatcgaggctgttcttcctacagttcgaaacagccgtaatcatggctgggatgaaacttatccctgccgcaatgatcactccatacccaaattgggccacccaattctcagccattgtaattgtttggaaagttggaaatttgaaattgtgaaactgaaaattgaaattgagagagtaaaaaaacaggcttgctgcttgctatcgaagaaaaaaggaagaaacggccagaagaaacgatctgaggaaaaggtgagacgggggattctgccataaccaccaaccaccgccttggggcagaacgaaatggttgccaacagacatgtacagacggcagatgtattactcaggcagcgttattaccctgtttattcgttactgcctatcctgagtctttgttgtgattctgtatattcgttgttattctacatattgttaagacaacatgctcccaaacatgccatcttttgttgcaatttccaagtgcctcctcgtccacctcatgttgcctacctacctaatgtaaatttcacccaactttcaattccctactggcttgctttagtactcataagaattatctttactttcacagtccggcagtaccagcatacaagacggtggaagggagatgatccaaagggccattgacgaccgttctgttctgccccaaggcggtggaggttatggcagaatccccaatctcaccacttcctcaggttgattccttctggctgttcctcgtctctttcttcgactgtagcaagcggcagctcttttttactctcttcatacaaatttttatacattcaatttcctatttccaatttcaaattccgaacaccgaagtatgtggtaccacaatggctgtccctgaagaatgggtcccttcgttggggatcggggtgatggtttccgggtttctggcctttgtcgtaggcacggccgttcgaatcgctcgtcaggagaggaacgaggctcgtcggaagaggaacgccgctcgtcaagagcgggacgctgccgttgaggagatggaggccgctctcgaggagcggggcacttggatacagagaataaaaggacagcatgtttgagagcatattgtctcaacaatgtgtagaataataacggatatacagaataagaaagaacacacaggacaataacgaataaacaggataataactgtagctacctgggcaatacatctgccgtctgcacgcgtctgttgacggccgcgtcttcctgccccaaggcggtggcagaatcccaatgttatgttgtcatttcttctgcttgtaccttctggtagtttctcttctttctttcttcgactgtagcaagcagcagacttgtttttttctctttcttgattctagattttcgcattcccacaacttttcgcattctcacagcataacgatgattgaagattggatcctttcacctttctgggcgccgattatttttgtcctgatttactccatcccggctttttttacatgctggttttattggcacacggccgagctcgaaatggagctcgctacgagggagctcgcccgggaggtggaagcccatgttcgggcgatggaagcccacgctgagcaggaggaagcccacgctgagcaggaggaagaccacgctcgggcaatggaagaccacgctcgggcaatggaagagagtaagtttccatggcctttcgattattaaaaccactctaacttggaatcaagtggaagaactccggcaggcaagggccagatatatccttggctatgagagggtcatggagcaactggccgccgccgagatcgccttggaaagggctgtgcgggctggactgcgcatacaaagagccgaacagcgcgcgcaagaggctgaacggcgcgaggacaacgccgaacagcgggcgatgcgcgccgcccgtcagttgcgagagttgcgccaggcgatcagaaggattcgggagcaaagcagctctgaggacaccgactcctcattctaaagcagcgacatcgaccagtctctggcattccacttcggtggttgtaagtccagagactggcccggaccttgggtctgtaggtcaggcgccgaagtcgaaattcgagcgcaccttgtctgggtctagtaaccacattcaacatacatatgtggtgaagccaaagcagcccccttactgtgcttctcattacagccagtataaaaacgatgtcgaccattcaatccgagaatttctattataacactcacaaatccgagtgacgatttctcagattttatctgcttcttgctggagagcaacaatgaaaagccctacaggaggaacagctccagccacttcatcaactcgataaggctttctttaagccgtcggatgggtcaagaagaacaactgtggcatgaatatgtacgcggagatgatcaaggcggtgccgtggaacttgcacaccgagacgaagacgcgactaccacccgaacaagactacgagcattaactcagccaagatcagcaaccagaaccatacttccacattttcgacattcaccaaattcgaccatttcaagcttccttcctggtaacggactcatcataccaactttggtaagaagcttagtaccctggctgagctctaatatatatattattggccgcctacttttccactttggccacctaggcttgacaacttcctgtcgccgaaaccagcataaaagaattcatacgctgccaacaccacccgccacatctctatcaggatccacatcataccctccatgatttgactgccttgtgcaatgatgggtgagtcaggtttacaatgatccctcgtcctgtcagccgacgggtatgcattaacaccgccaatactgcttctatcacgttagctacatcgcgagaggcttcacttggcggcttgtgggagctcgtgttatagacgagcgcggacacgttgcgatcagcgctggtagcgcatggatgcaatttttcacggtattacttcttgaaagagatggcggcaggaggtctgactttcgcatgtccaccactcttctgttgagtttggtggatcagctcagctggcatcaagccgttctcgtattctggaccatagaccgcgaacgtaaccctttgcattgttcgctgctggccctgggggttacgcttaaatgtcatgttgccgtccatcagctgaacagcgctccggaaaatgcatagcaaagcctcaagaaagtattctccatactcaaattataccgaacgattcatccactcatgggttccaggtttcggtcttacgtgagtgattctcctaaatctcctattcattcttctccattcaagtacctaacccattctgatctttcagcgccgacttacaagaatgtagaaaccttcgccacccaggatcacaggactggcgtacctatgggagggcttcatgagaatctacaccttactcatggcgtgggtgagctcatggttgcgaagagccagaagtctactcaaaaggtgtcaacctacaaataatttcgcttgacaggccaatatcgcgtctggatattgctgttccccagggaccataacagattttattctagaggtatggaatgtttggatccggtgctcggcgttttcctcatggttccaaagaggtcaatatctcgtcagtcacaaacacgacgggtcgcggtcaaagttcagagcgggcaagggtggtgatctacaaattcatcccagctagcggttgagccaattcaaaaccgctccagatggatccaactataatacataggcagaatgggctactgagaacccaagctcttctgttccgcgacaccagggaatgcgagttcacctgtggcaatcttatccttaaggagctcttgtgcttgttgcagggaattctcgtccgcaaacagcgaagcctcgagggatttatagatattttcatggcccaccaagagatcttttaattcttcgcgaactgctttggcagtgtctagtcccgcccccggctggaacatcttcatggtcgtctcgttcacctttttcttcgtctcggcatcaagaaattcctgaaatccacgtgttagaacagacgattgaagcgcggaaatccaaatcagggagagatcctacatcaatgtcggagctaaggttgacggacgctttccaccaatttgtatccagcttcatgtcagcctcgggattcaacttctggatcgcttcaacgtggttggccatgaacgccatcctttcctcacgcgataggtttggtggcattctggcgttttgaatctccggggtcacattgatgtcggacattgtgggttgtctgaggggaaagcaatgaatctgcggggtcaccagaagatacagaaggttgtgtcatcggctcaggctcgtgggccgcttggaataaataaactcaccatggggcctggcgctgagtcaattaggtaaaagattctaggcagactgggaggcattccgatggctgcctaaatgaattggggcagggcattattggttgcgggacatatggaggatgatatatgaggatacccctgtcttgattctgagtggtgcaaatacgaacatacaggacgagcactacttccagccaattcaaaaacgaggttttagtttcttggctggaacaagtgacatcagtaaaacatgttgcgccagccagtcgaccttacacgttataggaatcgtcgactctaaattcttagattgacaataggaacaaagtagtgaggaataaataaacccctgcatcattacttaaatcccatcgcaattgtagcggttatatttggttttgaagggcgtctaaagttccatgtcgaaaacaagagagtattgtctagacatgagttgcaataataagtacacatgataaactacttccagccaatactgtggctaggcacaaaaccgattttcttattgtgcttaccgcaattattagatgctcgtatatggcttagagaatctacgtcatagcgagctatcacattcaaaggtaaagaagtgagggcgaagaaaacctcataaagccaactcgcttgtctatttccgatatggcgctcgaacaaatgtccatgctcttcaaaattaaaatatcccattgctacctgtcctcgccatcttactgcaaggccaacgggtgagctgcgaaaaattcctcaaaagtcgtcagcttccctcggacattctcggccgtccatgcaaccagggtctcggtctccggcccaaagtacccaaactcctccagatatgcaaatgcatccccatacaagtctccagcaaatggcagtccttggacgaattcatccagaggtgcctgcttgtacgctaccttcttgccgagggccttgccgagaatgaccgcaagttcttccatcgtgtatagaccttgggccgcgtgaagcactttaccctcgaacttatcaggctcggcgaggatagcgcccacaaatttgccagtgtcgctgacggcatcatagaagggaaccttgatgttgggagagttgggcctcgtaaaggtccagactccgtctggtcctggcttcgggctgagaaacggttgctcctgaaaattttccatgaagaagccgcctgagaaaaaagcgctcttgatcttgaggccacggatgtactcttcagccttggccttggcgtcaaaggccgtcacctttgaatatttgccgccggagatcttgctaacataaggaagcgtgctccagatgagatgctgggcgcccgcgctgacagcaacatcagcaatagtttttgcgttgctgaattcaacctcgacggcgttgggactaaagtcgggagcagtcatggcaaagatggtgtgggcgccggcgagggctgactcgattgaagatcggtcagtcacgtctccagcgacgacttggacacccttgtcttgaagctgtttggccttggttgagttgacatcacgcgtgatggcacggagagaatactgctgagacagttctgggtcgtttaagacgttgttgataacggagcttccctggtggccagtcgcaccaaaaacggcgagaactcgagacatggttgataaagtgtagaatggaaaagtgtttaagaaagaatagatatgtcacgatggtgggattgatctgtttctggagacaaaattaaaggccctccatgccctatttattattctacgattttacatgttccattgtctagctaacatctggatgatacattcagtgagagtgcttcataagcgtgatggcccgtggtcccgtggagctccgtggaagaatcggcataccacggccaaaaccgacggacgtttcattccgcaacgaacaacaaagtcaatacgcacccaaattccattgcgcaatacttgaatgtactagtaatatggtttacgatctatctgttgtgttgagatatcgagtctggcatatttcattgctgtttttaacttcatactcgaactctcacacccgttttactaccagttaatccaaatatcgaagaatatttggtacccaaataatgacttgcaagtcatgccattcagcactatgcttccaggctgttaatacgtacgtgagagaaattgactacaaagttaaaaaacagcaatggaagataccagagcccgacatctcaacacactgaataacgttgtcgatttaggaaagcgggagaaattataatcatcagcaataccgatgcgcgactgaacacaaaatcagggatcaactaacgtttcggatatatagtgaactgcatcaatcttgtcttggtccctatggacctacattatcctgaaattcgcttttggcagcctctctcacggcgtgcaaaaacccgggaagctcagggactgtcgctcttgggggcattctgatctgcgaataccccagcttccgagaccgccgcagatgagtaaaccagtcacacaactccatgttaggttcttcaaacctctcatgatggagtcccatttcttcctttaccatgtcttgccagagtcccatgtccctgcctgttgcgcacccagggctatcgcaccagaaaatatgcttgttcttctcgtggaaaatcccggccagcgtgggtaaatcatctaggagactcagccacgctgggctggttggtttatacacgctccatgagtatcgatatatcagcgttatgcgtccagatgtgagagcccaggtatacaaggccccgcaaccttcacatgtcaagaattgtttccgggaacgtgcgcatccattccagtgacgtgagcattcacatggcgtcccttcgaacaggcctatgtcaggagtttttgacctacccggcttcctgaaacagtcgcaaaccgcagccgagatgaactcactaagagcctttccgtctgccatgtgaggacaagtcttgtgattccgaagagcacctcccacgatcaactgttgaagggtatctcgaataccctccaggctgggaggatctctgctatcgatatccagcaacggaagatcccaaccaatcttaattgtagtgtgagaatccgccggggggggccatcgtatgaggaacatccgcgggaacgagtgatatttcgtcgagcctttcttggaacatcgctgatgctccaggtgggggcatccaccaaacttttcgatgtttggaaccgagaggatgtccctgagggaatcccacatgataggctccatgtgagagcacagttcccatttacccagtcttccgatacaaacgagattttcatcgcccctttctatgctttcctgggggaaaaagatactggcatgcctctcaccgcatgcatcgcaaaatcgcaactcgcgaagcttgatcacggcaggttcgaactcgccacggagacggaccttagtgcatgccgtgcaccaattcttcacctcttgctcttgcctcgattgaagcattgcgcggccttctctcctttcctcttctgacatcatgccaaaggagagtttcatgtgagcatcatgcagacccgcctcgtcgtgaaacgggtaaaattgccggtcgtcaaaaagggttcggaaaagtgctgacgcctgtcggagagaccagagagatattggcgtcagacccatcattatcttgatcaatacgggctttggcaacatgaagatcgggctttcctgccgcggtcggtcagttcgctcatatataagacgagttccctcatgtatgcgaccaatttgctcatgtatgcgacgagtttgcacatctatgcgacgagtttgctcatctatacgacgagttctctcatatatacgacgattttgctcatgtatacaacgagtttgctcatgcatacgacgagttccctcatgtatacgacgagttccctcatctatgcaacgagttccctcatctatgcgacgagttacctcatctatacgacgattttgctcatgtatgcgacgagtttgctcatctatacgacgagttccctcatgtatgcgacgagttccctcatctatgcgacgagttacctcatctatacgacgattttgctcatgtatgcgacaagtttgctcatgtatgcgacgagtttgctcatgtatgcaacgagagccttgaacttttgggggcatgggagaatattgtggcggatctggaaagggcgctgtaggctgaggagggtcatgaggttcaaggaaggatgccgtaggctgaggagggtcatgacgttcagggaaggatgccgtaggttgaggagggccatgaagttcttggaaggatttcacaggcttgagaaggcgagtaccatttaggaaggatggcgtaggcagaggagggccatggctaaccctaagtattcggaaggatctcacaggctggggagggtcatcgcgtttctttgactgagaccctaacaacgagcgccaccaatgtcctgatttcttgggcggggcggtgatctgtatgtaagggctgactgctcgctcatcggctttcctcgaagcagaatcttcaacctggcctcgttcgtcgtctttcatgaacgcagaatcttcaaccacgcctcgttgatcgtctttcctcgacgcagaactttcaacccggcctccttgatcgtctctcctcgaagtggaactttcaacccggcctcgttcatcatctttgctcgaagtggagtctccaaccaggtctcgtttatcgtctctcctcgaagcaggaccttcaaccaggcgataggggggggttgatccaaatgcatgccttgtgttgtgtctgaggtcatgccgcctcgacacaagactggcacatcctgcttctgacatggctcgggacatgagagactttcaaaaaaaattttgtgatgtttggtcaacaagtcaaaaatttcgaaggatatttctgaatctgaataccgatcaaaatctggcatgataacagggtagtctcccagcagatctagtgggtacttttgaccagacattcttgctcgtggaagtacttcagatgtatggggttgtgtcggggctgttcctcatttctcaatgattgtggaagcctgagtatgagggacggcatctcctttataccgtccccgctaacaaggggcctgattctcagatctctaagtttcctggtgcagctcatcctgagagtatcttggattaattttcgacggcttgctagtaagaattgtcatcgtccgtatattacgggaggtgtatcgcgagggtgcgcccccaagctcaaactgaaaccttattagagtaaattctacatacactctaggaataatgatgagctcttagtgtgagtcattatcatgtggcagtactcacttgtatgaactagcatgatagttcactaagaaaggcagaggtgagtttggtgttgttacacgtccaactcccaggatgagggtggaataatcatttaccatacgacaaacaaaaagtttaatgggtgcctttgaagtaattgtaagtagccgcaatccggccccatttccaagctcttattggaaatcaaaatgcctcgagtgatggctcgtgctctccatatgttctgtccgcgccagtagctaacgatgacaagttccttgatcgcggcgtcatccactaatgaatcctcctagagaaatcgacaaccttctagactctcttgaaggacaaagatgacctgggggtaattcggaaatcaaaagatgctgggaggcaagccgccattgccaccactttgaaggcgatggctgatcagagttcgagcataaagtgaaaaaataaagatgccagacccgacatctcaacacgatgactgccaaggcaaaattaagccctggtagcccaatgctgcagccatgcggatggaaaactctgtaaaccttcatgccgatgactcacttgcttggcggcgatggcatcgtgcggttctcgtgtcccgaggaagcgggggcagaagtcgagactcaagacagttccaatcaaagtcaattgccttattcataaagtgattctcgcatcttctgtgggccagcagactttacaaacttgaacctaaatgatcgtggtgcgggcagtcgtcattctttactcgctgccctggagatgaaaaatgagggaaccagtcacaacaagaagtgaaaatgggtaggcatgggagaaaccaaggccagtagtcaccaattttattagtaaattcttttcaagcctcaataccaaaccgaatcgtcacgtattaagccacgaaagtacacatctttgacagcagcctcattgtttctccaagtgaggccgtcgcagtggagctggagtgacagcggagtttgtgtacagaaatcctactatctgctacgtcattgttcgaatcttgaacagccgtgaatcgaccaagtacagacgggggacatatctcgcagggaatcagctgtaacctcgacgaccacggagtccgtgccaggtgcgcaggccgcaggtgcttgcagccacgtggaaaagaccgaatacgccgagatggagaatgccttggactccgctaacacagccctacggacgagcttattctgctcgtcaactaaaccgacatgacggccagtgaagcgtttgtagcccgcgggttaccgtacccagttttcaccgtggttcgccgccccgcgggtcccagaccaacaaaaggggcaaggtgcggcagctcgccgcatgttactttacgtgacggtttgtgtcttctggtgaatcggcccaaattccttccggacaggtggatcacggctttcggctttggcagctttgagccagtcacagtctcgagcttcgtctgacaacggcctccggccaggttaaggtgcagggccaaatgccggggccgtggtgaagaggtaatctcaattgattgaacacagagaactctgatctcgtaaatcttggatattaatacagtcctgcaactgatggccacgaccatgtctcgcctcaccaacaagaatcgctaatctcgagtccattgtcatcgcacaatccgatagacacgacgcagcaattatcgcatctgaactgaaccaagtgcttggaaagaaggattttctgtctggcagcatgtcagatcgggcgccgagctacgcccctgagcagccagcccctttgtcagacggctcgacactgtccgggaaaatggaggactcagcagatgccacatcggcaacagaacccatcgagaggaatttggaagaactggcacgtcaattgacacacaagtctcagaatatcaccgatgagctacaaccatacaaccccgagccagggagccacctcgacccccaatcaccgtctttcaacgcacgtgcatgggtcaaagcgtttgtcaagctatctgaaacggaccccagcgcggcctcctcgcgtttcttaggcgttgcgttcaaaactctgggcgcttatgggtggagcactggtgctgagagtcaaccgacggtcacaaacattgctctacgagctgtcacctccttggccgggcttatcggggggcgccgtcaaggcaagcgcatcgacatcttgcgcgactttgagggcgtcatcaaagagggggagcttcttctggttcttgggcctcctggatctgggtgctcaaccttcctgaagacgctgacgggcgagacatcgggcttcaagattgcggaaaattcatacttgaactatcgaggtaatataactttgctcacttgaatgataaatgaccatggcgaattaatgagtctttgatataggcattgacccttctcatgttcgaaagtcgcttcgaggagatgtcctctacaacgccgaagttgactcccacctcgcccacctcaccgtgggcgagaccctaacgtttgcagcacgctgccgatctgtccgtcatgttcccggtggctttactcgagaacaagccgataatatgatccgcgatgttatgatggctacgtttggtattagccatacgttcaacactcgagtgggagacgactttgtccgtggtgtaagtggaggtgagagaaaacgtgttagtatcgcggaagcctgcctcaccagcgccaaattccaatgttgggataactctacccgtggcttggacagcgcgaatgcaatcaacttttgcgagaacattcgactccaggccgacttgatgggcgttgccgccgccgtggccttgtaccaggctcctcagtctgcctacgatgtgcgtattcagtgaaaagcgtcggtgtacctgtcccagctaacatcttgtcagaaattcgatcgtgtgattgtattatatgaagggcggcagattttctttggcaaaaccaccgaagccaaggcctactttgaagagctcgggttcgaatgtgagaactttcttatatctattaattgaacctaactgacactgtttcgcaggccctgaaagacagacggttcccgacttcctcacttcaatgacgagtcccagcgagcgacgtcccaaagctggctacgagagccaggtcccccgtaccgctgacgagtttgctgcgagatggaaggccagccaggcacgcgacagcctggttcaagagttgaaggcatacgaggagaaccacccctccgatcagcgactcaaggaatacaacgagtctcgtaatgccgagcaagcaagaagccaacgctccgcatcgccttacacgatctcatactaccaacaagtacggctggcgctgtggcgcggctacagacggctgcgtgctgatcccggatttaccgtcgcttccttgctcttcaacgttatcattgccctcctcctgggcagcatgttctataatctcaaacccgacacttcgaccttttattaccgaggtggactcatcttcttctcgctcctcttcaatgcgttttccagccagctcgaagtcttgactgtatatgcggaacggcctgttgttgagaagcataataaatacgccttttaccaccagtcgacgcaagcgatcgccagttatctaacagacctcccgtacaagacagctaacatgttcattttcaacattctcatctacttcatggcccatcttcgtcgggaggcaggcaacttcttcttcttctgcctgacctcctacatcacgacgctggtcatgtcgagcctgtatcgcctcctcgcctccattacacgaacatcccaccaggccatggttccgagctcgatcctgagtctaggactgatgatctacacaggcttcaccatcccgactgactacctgcccggctggtcgcgctggatgaactacatcaacccgctcgcttatgcctttgagtcgctcatggcgaacgagttccacgaccgacagttcccctgtgccgttgtcgttccccagggggctggttatgaggacctgcctgctgactctcaggtctgctcctctgttggcgctctgcccggctcgatgacggtggacggtgataggtacatcaacttggcgttttcgtactacaacgcccacaagtggaggaacgtcggcatcttgttcgggttcttggtgttcttctttggtgtctatatcttggcagccgaatactcgaagccgcctaagagcaagggcgaagttcttgtgttcccctctggcaaggttcctcattctaaagctgccgactcgacggatctcgaggctcagcctcgcggtcgagaggttgtatctgatgagaaatcgacaagtggttctgagtccgctgctggattgacagctggaacggccgtgttccattgggaagatctgtgttatgatatcagcatcaaaggcaccgagcgccggattctggatcatgtggacggctgggtcaagccaggtacttcgactgcgcttatgggggtttcgggcgccggcaagacgactcttctcgatgttctcgctactcgtgttactatgggagtggtatctggagatacgctcatcaacggttcgccaacagacgcctcattccagcaccgcgtcggctatgttcagcagcaggacctgcatctcaacaccatgactgtccgcgaggcccttgaattcagcgctctcctccgacagtctgcggagattccaagaaaagaaaagcttgagtacgtggacaaagttgtcgatatgcttgatatggagagcttcgtagatgctgtcatcggcgtgcccggcgagggtttgaatgtcgagcagcggaagcgcctgactatcggagtcgaactcgctgctcgccccaagcttctccttttcctcgatgagcctacctctggtcttgactcgcagacgtcctgggctatctgccagcttatcaagaagctgacgagaaatggccaggctgtgctctgcaccatccaccaaccgtccgctattctctttgaccaatttgacaggcttctgctccttgcccctggtggtaagactgtgtactttggagagttgggaaccaactcgaggactcttatcaactactttgagcgaaacggtgcgcatacatgtcctcccggagcaaaccaggcagagtggatgctcgatatcatcaagccaaagaaggatggaactgttggcatcgattggcacgaaacttggcggcaatcgcctgagttcaaggaagtcaaagctgagctggggaacctgcgcgcactcgcaaccggacagaccctgatcgcatccgacaacagcgaggcatcccagcatcgcgagttcgtcgcctcgttatggacccagatgtctctcgtcttcttccgaacctggaggcacttctggcgttcccccacttacatctggtccaagatcatcctcatcgtcatctcctccatctacatcgggttcagtttcaaagcagagaacacaatccaggggctccagaatcagctgtatgccatcttcatgttcttagtcatgttcaacaatctgaatgagcagatcatgcccatgttcgtcccccagcggtccctctacgaggtgcgcgaacggccctccaagatatacaagtggaacaccttcgtgctctccaacatcctcgtcgaggccatctggaacacgctcatggctgcgctcatctacgtgtgctggtactaccccgtcggcttcgtcatcaacacgactgcagacgaccaggccatacgcggatttcttgtatttttgttcctctggatgttcatgctcttcaccagcaccttctcccacttcgctattacctggatgccgagcgccgaggtagccggcatcctcgccagtctgctttggatgttctgcctctgcttctgcggcgtcgccgtcgctcctgccgacttccccaggttctggacgtggatgtaccgcgtgtccccgggaacgtacctcgtcggcggcgtcatgtccgccgccatcgccggctccgacgtgacgtgcgcggagaacgagctgctcgagctctcgccgcccggtgggctgagctgcggcgagttcctaggcccgttcgccaactacactggcggggctgttctgaaccccgaggcgacggatctgtgcagctactgcactattactaagactgatcagttcctcgcccggttcgagattgactatgatacgaggtggagggactttgggttgctctgggtttatattgctttcaatgttggtgccgccttaggactttactggctcttccgtgttccgaaggggaagaaggggcttaggaggtcctaggagaatacacttgtggggggagctgtgtgagaagatatgaatttttttgttattggcatagatttctttttcaaccttctcatagattgggcatagtataatcacggttagatttcatcattacgttgtttgatacttggtaatttagcacatttaatgtttgattctcccctgatgtggttgttattatttaaggtcggtatgtggctctccctgtgtgtgagcaaatcaaaagcttacaactgaactcttcgtccaccattcaactcgtagtcacgtataggatgatggacaggggtcagtttccatatatgactaaattttgacggtcgctgcaacaccaatcaaagcttgtttggtctaatggttagtaaatcccgcagttcccaccgcatcttgaaacaacaatctaacagcttccaggttaggatcatcgccttccaagcgatgggtcggggttcaattccccggacaagcatttgtttttattcgcgggataatttctttttgctttgtggtgttgtgttgtcgttcaggtccatcgccaacatgatgtgttacgcggcccgcctgtatagcctaccttgatagcggaccgagttttttcttctcggcctctgattatacatggctatttctattattatctcacttctacgaaagcgctgattcactttggttggggttagggttgccctatgattgtctcagttgagttggttgttacgcctaggattcacaccgatatccacacctgtagagatgcatgaggccagagcgcaggctctatttcgcctgacaatctgaaataatctactgtttgccgtgattcgaattaaattgtgcgccgatgatgcttggttgatcaaggactttctcggagaggagcttattgctgtcaaggccaagcgctgttcgtaatattgaagccaggaaggtcgtctactctgacgatcaagtcagtaagcaaaaggaaattcccaatgccgcctttctcagattgaccttatatgtcgccaaatttaccctcccaatatctaaatgggtcacgttctttcagtgcgcttcagctactagtggaaatggattgctaggaatccttcattgggacgactctatatgctaaggaaaatgctattgatcactaatgtagtatcaatagtgttgctggcgcggctggagattttatgctacaccattcatgaattctttccacttcaccggttacaaatattcctcttcctattgacttgtttcttcgcacattacgttagatgctagcaaggtacgggtatcaaaagccttcttctcatgaaaaattatgtcgagtactcagatcgtagctgttgaagcaagactgaagggcaatcatgcgttggagtgacctactcccctaccatttattccgcttcgtcgacatactcgtgatatttattctctaagagattaagggaaatagattttattcggatttcaggattgagttaggcctcagcgaagtggtgttatatatcatatgtcatatgaatagaatttggaattaatctacaagttgtcttttccagagccagcatctaataacctctcctcgatgaaagtcgcaaacatatccaatgacttcttgggactgactatatccaaaaacggtacgtcgaccttgaacacagaccagaaccacgtccggtactcggcagctatcatgctatccaccccataatgcggtagtgccttgtggtcgtcaatctgatcctgcgagagcaatatcaaattagagaagcgctttcgtgctaacctcaagatggcttcatgtagggttggtgcatctgcctctgatgccagtgctttggttgtctcagatacatttggtggcaaggccttgaaccacggagaagctatggccatacttgtggtaggggcggaagatttgttgtttgtgtcttgactggcgagtagttcggcggctagaaacccagctctgggatcttgcgttgtgccgttttccacctcaaagcctttcttgatgagctcgcgcaggccgaagggttcaaggcctgtaagaacgtgagagactcgggtctctgctgctaatgccatatcaacgacgtttaagaactcatcctcattcaggggctggatgcctttgcgaagtagtaacgcctcgatgtcgggattctcatgtagataaccaacttctgagatcatacctagcccaacggagacagctggttttccttggctctggcgatagcgtgcaaaagcatctaagaagccattggccgcgcagtagttgctctcagtcgcagtaccaacactaccactcacggatgatgtcagcaagaagaaatcaagatcagcatcgtgaccattaagttccagagcacggtgcagattccaggagccgcgccatttgggctcgatagctttgtgccaagccgcatgaggcatgcgtgtaaacaaagcctcactcagacccatagcagcctgaaccacaccaccaataggccggccagcacatgcattgacggcggcattaacatcttcctggttggacacatcaccacggacaacctcaacgttgacaccggcgccctgaagacgagatactagctcctgtgcttcgggcctatcgcagcccgaccgcccgaggaagacaaagtttctggcgccacgactcaccatccatcgacttatactgcgcccaagaccgcctagacaaccaattagaaggtaagtcttttctgggtttagaatggtgctatatcgagaaggcatgacctgtaaaacggattcccattagccaaggcatgatcgttagttagatgtagtatcctaaggggagtaggactaaccgggatgaggctctgtgggttttccaaagatacaacgacttttccaattcgatctctcccagaaaagaatcggtaggcctgtgaaatcttggaaatatcaaaggtggcaatagggacaggctttacctgtccacttcgataaagctctaaggcttctttcgttttactatattattgttagctaaataatcctcaaacaaataaatacataacaatattactttatccaaatatctctataaaattgagattcgtggaagaacaattcggttaagtcaaaggctgtgaaggtacaattgcgcagaaagacgcgcatgtcgagctttccagcgtcaacgagctcccttttccctacctctacaaatcgaccaaaatccgctatgcaatcccagctatcatgcatgaggtcgccgacaagagagttaataatgacatcaacacctcgtccatttgtggcagctcggacaccgtcgacaaaggacgagtctctagaattgaaaatattctctgccggcaaagccagctcacgcatgaggtagtctttcttcgcagcggatcccaccgttgtatacacaactgccccgatacgctgtgcgagtgcgattgtagccattccaaatgcgccggcaccactgtggatgagtattgactcgccagcacgtagatgagcccgatcgtgcagcgcatatagtgctgtgccataaatcacgggaagtgttggcatgacgcaaaagtcttcggatggcagcatcttgtgtgctgcccaggctggcacgcgctcaatggtggcaaaccggttcggtgccagtactacagcatgatctcctggcttaagatacgacacatggtcaccgacagcaactacaaccccggagaactcgatcgcggcggtacccgtgcgcgtctctactcggccactggcagtgtacacgtccttcgcgttcaggcttaccgccttggtccggatgtcgacaaatccgggtggcggtttagaaaggggctgagtttcttgaacgagatggagtgtgtccatctgcccaactgaaccaatacccaagcgcgcaggacctattttatcgaacaatagtttggttattggttccttattgtctagtcgacgacggaataggctgttgaactcgcttattgcgatgaagcggctgatatacagcatgccatccttctcaatgaattctttgtcatccatgtctgataccgaggcaagagcttgtatcagattcaaggagaacgatttctcaaagctcctgttctcggatgctaggcctccaacatcaatcacggtgaatcggagcgaaggctgttctagcataagagctctagaaagaccttgcgagagcgtaagattcggatcgggtgatgagctcagcatacctgcgccggtcaaccaaaccaaattgttagcgatatcggtgatgcgacgaagaaggtccattttcatagggctcattgtagcgaggaactcgttctccagctcgagcagggaaatgtaaatggatgtggaagacatatccgagttctccaactcttcaagtgttgctatcttgatatctctatcaaacacaggcatttctttcagatgctgagtaagcctctgactcaattgctgggtcaacaagctgggcacgaatggagtgataaggacaacatctcgacccgacaggttctgtacaggaggaggttgtactgccaagattacgccttgaccaacatccatcgctgtgaagcccaatgaccgaaggatgtcaagactagtccttgttttacgtataatcacgactccaccttgtctggtttcgaagatggaactaagccatgttacctcatcctcgacgtaggatgtcgatgcagataactaaagccagaaattaaagactgtcagaaataaagaaaatctttggaatttaatgataaattgagacttacctcaggaatgatgagagtgtcgaatgagccatcattttcatccgtgtgctcaaggtctccattcgttaactggcccccaacccaagatcggcaacggggaaatgacgtttctgcctcaagggtctcaagccatcgcttaactcgacattggctgtcttgagcaagttctatgacccgcatcttaggattcttaaagctcgcgagatcaacaagcgcgacaatggctgccatgctggggtggtctctcaagtcgtcaggcatcgcgttaaccttttgctcaatgtattgccggatttcatcgatagattcggggagtaatcgcagaatgtcgggtttccattgtacatcgaggcagggctgacgcttcattgagccctcctctgcgtatggtgtggtatcagaagacgtttttccattataaagagtcaagcgaacgttcctcatatcaacaagacattccccagtaatgctgcctctgagggtaccatctatctgcttagtagcaaatccagtcgtgcgagtccgcgagtgaatgatagcctcagtttcaccgaagttgggcgtgtagattctgcatgattggatgaagacaggcagatatgcgcgaagagatcttacatcaccggctgtcccaccaaatattccggcctggagtagagtgtccgttacaagagggtgcaatgtgtatttggttccgctttttgaatcctcactgacgttctggaacactttggtggtagagatggcttctggtcgtcttctgttgccatccgttctcatacccgtaatcgactgaaacttttctccaaaacaaagaccctcatgtgccagcttgctgtaccacttccccatatgccacgattcatacgcttgtgtattattaacggtcacagtgtcagatggtgcttgaagattgttgccggcgagcagacgaatgctgcctgagcaatgcaacgtaggtttgccatcatcccaagaggatactgcaaagtcgtaccaaatagccgactgattgactgtggaaagttttcgcgctgataaagaagtatgaatctctatttgactgttggtttcctccggtactaccatagcagcgccaatgctgacgtttagaaactcgaaggccatgccgggagtcgaaggagttatatcgcacacctggcataccgcttctattgtgagacccaggtagccagtggccgggaagacaatctgagaatcaagcttatgatcacgcatccaaggaacctcagatagccgaagcagattccgccacgcccaatcgatgccgtttccggctgtttgcagtactccaagacgttcatggcgtagatgtttacggttacgctgttcaatgctggctcgtggctcactccatagaagtggcccagaataatcccatgggtaaggaggcaacgtcgaaagaggaggtttgataccacacagagccgtgttaatgctgtcccattcaagagagtacccatgaataaacaaatcgccagcgagcttcttgctgcatttgtgagaatcctggtcgcggaccagactcggcgagtaatggaagtgatggcccgtcttttttcggatcatctcaattgggcctttcagggcagcatgagggccaatctcgatcacacgcatcttcctttctgctgtcagactgctgagggctccgctgaattgcaccgtggattcaaggttctgacgccagtaacgagccgcgcaagtcttcctgtcactgtctgcaccaaaaacagccaaatcttcttctttctggcctacggatgagtacatcttggctctatgcgggtttgtggagtcatgctgctggaagctgaacatgatctcgagcatctcctggtacagcgcgcccacctccgtcatcatgtgcgagtgataagctctcccaccggtctgcaaagctctagaaaacgcaccgcgtttctctagtgttttcttcactaaatcgatggcggcgaattcgccgctgagcgtgatactttcgggtgcgttgacgcatgcaacacaaacacggcctgccaagtctaactcttggatcaactcatgggccgcatcaggggtcaaaccagctgcgagcattgcacctcgattctcaagttttccaacagcagcgccgcggaaatacgctacttgaatagcctgagcagcactaaggtggccggctgcataggcagccgcgatttcaccggacgagtgaccaacgactgactctgcttgaatcccccatgagtcgagaaggtctaccagagcgatttgaatcgccgtgcagacaggctggctgcgtgtgacgtcgtggatcatgctagtctcagcgggatccaagattgtctgttccagcgtccaggagggtctctggtcacgccaggggatagcttggagcactgcgtcgagctcttttatcgaatctcgaaacactacctctctctttaggagctctttgcccatgccgggatactgagcgccctgtcctgtgaatacaaatgccaatggtagcgcatcaatgtctttgccagacgccataacagcgtcctcagcgcggccgtgattagcaatgatgaaggccctgtggctgagatgagcccggtgctcacccaatgtgaacgctattgatgacagttcatttgttgtagacacgctgttgacatagtccttcacctgctcgatgcgcttctccaacgaccatttggatctggcagaaattggaaacagataaacgtcatcagactgctgactgtttcgctcttcagtcgctgtgtcaaattctccgaatgattcaatatgactgttgtctttgagaaagctcttcgggtcttcaaggatcacgtgggcgttggcaccgccgtaaccaaaggagttgatactggccctccgcaactcccgtggccattccgatagttcatcgacgacctgtaagttgtatttgtcaagttgcactagaacatagtaagcctcgttgcaccttagaaacactttcatgcgggtccatgcttacgcttggggtttagtttggtgattccatatgtaggtggaatttgccctttctcgaaggccaagaccgctttgattacggccgacaaaccacttgccgcttcactgtggccgacatttgttttgatctagggtttgtgatacgtgttagtggctatatttatattccccagacattgagtcatcagacataccgcgccaatcatcaacggtggaccataacgcggcgagaaacaccgaccgatgccctcaacttcgacgggatccccaacggcggtgccggttccatgacattcaacgtaatcagtgtctgccatgttcaatcccgcgttggcgtaagccttgcgaatgacagcttcttgaaaacgggcactgggctgcgtaatgccgttggtccggccgttggcattgactatttagccctctggtcagcactattgtagttttcaggtctggtgttcaacaatggttttcaacttactggcagtaccccgaatgatggcgcgaatattatctccgtcacgtattgctcgtgacaggggcttaataagaacagcattcactgcctcacctcgcccatagccatccgcagatgcatcaaaagtgtgacaagttgatgttggagagagcaccccgcccttcatagttcctagatgctgctcgatagaggtaatgaggttggctcctgccacgatagcagcactgcaatcaccattcttaagtgccataactgcgttatgaaggccgtagatagacgaagagcatgctgtgtcaagagtgaagctcggcccagtcaagttgaagacatggctgatgcggttagccattatggccgtcccagaacccgtcgcgctgtaccgatgaaggtagtctgggtctcttgtttgcattgtctgataatcaacggtgaagtttccaatgtatacggccgtatcagtgcctgagacgtcctccatagataacccagcgctctctagacactcgtacgttacttccaacaacttcctctgttgaggatccatgtaagttgcttcgaggttgttgataccaaagacgctattatcgaactgccgaacatcctcatcaaggaagtagccgccatcagcgtccataacaccagctctcttaccatctggatggtagtaaccggcgatgttgaatctacctgcaggtactcgtccttgggttgtctttttagctgcaaggaggtcccaaagatccgagggggaacggataccaccaggtaggcggcagcctagatgcttgtcagttacttgttaagttgagagaaaaaagctgagtttaccaatgccgacaatgcaagccaagtcatcgtacccacttgatcctagcttcgagtctcctgaagtcgattcaacgtacgaagccacttcatctgcaatagaaaccgagcatgcatccgagctttcaccagtgctaagttcgacttcgagggttttcacctcaatgggcgattttttcgtagattgtatgggttcaacaacaccaagaggtgtgaagatggtggttgacatagtggcaatgcaagagctctaatgggataaatgggccttcaacctcttcaggaaaatttgaagtatctttctgctgttatttggagagaaaggggaatccaggatctattctaggtataattgacaatctcttaagtacatcattttcaaacaagccgtatctggtttccatgagtcatcaacctggtactacatgagtatgagtttcttcagctctcgggcatacgctgtcatccctggcattgcacctttccgtagataatttcaatatgcaaaaaaagaaatctagaaccacatcgatgtggacttttgtccgaatattgggtctagaccatgccgatggcaaaactattctcttgtcatacaggacattggcttatctcattgcccttcctcaagcccagcccgctcggtgattaccctcatatggcgcaatgccgattcagctcgccgatgcattaatcagattcggggattccgagctcaactatcaatgcccggatatcagaatttgaatcctagggtcggagaagcaggcagaatcaaggtggacaactcgaggctttttttttcaaataggcgaaggcaaatcatcagttaattgagtctccacttgcacgtattacggcaattattatagtattgtctctttaggccgtgtttcaatactttctttgccttcacgttaaacaaaaagttgagatgtcaacacgcaaaaagtttgcccttgttacggggtaagtgattgattcctgattgattcggagtccttgctgatgacttagatgtggtcaagggggtatcggtgaggctcttgtaaaggtatatgccgagcaagggcttcaccctatcgctacgcttctaccgtccgaacccagtgatcatctttcagaagctggaattactttcttcacattagatgtcaccaaggaggactctatccaagacctaaagcaccatgtggtgggacttacaggaggacggcttgatatacttgtcaacaatgcgtaggttttcatgaattcttctcatcgcttggaatctataatcggttcgatactgaccaagcttcgaagaggaatatgtatgaacaataggtctcctaacgcaaacatagctaagtgtgtctaggctataccatgacggcaatcgataccaaagtgggtgcagcatcaaagatgtttgacgtaaatgttctagggccgatgcgcatggttcatcatttccacgacctactcataagcgcctctggcacaatcgtgaatatcggatcagttggcggtatagttccttacgtttacggatgtgagttgaacaataaaagatccagaaccgctcggttgactaatcccaaacgcttcagcatcgtataatgcaaccaaggctgcacttcaccactggagtaatactttacgtgtggaaatggcaccactacggcatgtttaatccccacattaccctccaattctctgctaatagttaatttagcgttaaagtaatgacagtatgcaaatctcccttgagttatagccaattgtcctaaactctagctgacttcttatgtctcgctcaggtgatatccggaaacattggaacgaatattctcaaaagcgatcagaaggaaaacagagagattcccccaagtgaggcttcttgtcatagcaataccgtcatagaatttaatgagacgcaaatgacatataatgttctcactaacctaggtggttccagattcatactttcacccattaaaggaggaatttcaaaaacacataacgagagttccaggtaaagagaaaccaatttccagatacaattcaatatggcgctggacgtaaaattgattcgaaaactctttctagttacaacagatcgctttgactatgcctcaagggtcgtgtcgcagagtctccagtcatcgcccgctgcttggttctggtatgggaaaacaacttggctcgtacgattcttagatgcctttttctggcgcaccatttgggtaggtacatcatgtcaatcaaatataaaatgtactgagttcgtttgtctaacatgcttaggactctctactttggagaatgttcgattttgggaagttgaagagaacgcacgatctagctcaagccatgccacgaagtaattagcagacttaaattgtccatgtcactatttacataaccaaataattttcatttaagttcatttgctgttgtgactcttcttgcgtaattgtgtcaatttttctgctcaacaacttaccatcttgtaccagacctagtcaaagtgttgatgagaaagcatttatctacaggtattaacacagaacatcaaagaaagaaatctcgttgctacctaaaggtgtatgcatgaaacctaagcaaaaggcagttacctaatgagcgaaaggcaggatttgtacgttagagaacgactgtatgagcagctgagatgtttatgcctctcgttcatggagggaggtcacttcaacatcgttcatcagaaaaaaggaatcacagtcagtgcatgcattttattgtaggctatccttagaaatccttggcattcagtagctgaacttaatcaacccctttcatattcctttgccagatgccccaagaatccctccaccttcttcccaccaacgactatgtcattgcatggaagaagcacccaaagcattctaccaggcattgtaccattccccgtgatattcttccatttatgcgaggtagctcgctgaatgctgacatcccctgggcgcatgatgcgtgactcaccagagtcaagagtgagctcaaaaactccttcaatcacaacaccatagtcgactgagatagctcggtgaagtggagactcgattccaggcccaaaatcaatcatacggacgacagagccattggggtaatggagtggaggctgctaatattagaccacgtgcaatgcatggaaactgatgggatgtaacttgcctcggtctcttcagcgaacttgatgtcggcatcgccattacactcaatgggtgtctctttggttgagtacaagatgtttgccacagcctggttgtctcccatattacgatggtgagagccacagtcggtaaccagaaacacagacttgccttcggtgtcatggcctgtgatgtggcgctgggttcgaggcaggccggcagctgggaagccatcggtgatgtagccctcagcgccttttggcgggcctccgttatcattagcggccattttatagaatattacaatcgtccaaaaaagggttggatgtctgcagagaagagagcggttgaaggcggaacaagtgacagctagattcatcaattcaaatattcagacgatgatattcaagctgctaaggccttgatcatacaacaggagagcagttctcggtgattatcaattcctagacaagaaatacacaagagtatcaaatctagaccttcgttgtcaatgtcgtccccccatccacaataagcccgcagcctgtgatgaagctagagcgctggctacatagaaacatgaccgagtcggcaatttccttggcatgcgccattcggcccatggggaccgctgactggataagtttctcgagatcggggacttgatcaatcgccttgcgaaccatcggtgtgtccacccaagacgcgcagatgcagttgactcggatacccagcgccgcgttgtccagagctaacacgacaagtatcagttgtaatcacattgtgagcggaaatactcatttcataccggaattcttagtaagaccaaggatggcgtgcttggacgtggtgtactgcaccatctgaggcgtagagacgaacgacgccgcagatcccatgttgacgatcgcgccacggaccggcaatggcgagtccttgattggttcctgagctgccatcatcgacgacgccgcgcgggttaccaaaaaagtgcccgagacatttacatcaagaaaacggttgaactctgccaagctcgcctcggcgatgggagccgccctctcgacgccgatgcccgcgcagttgacgcagtagtccagccgccccgaggtggctctgacgcaagccataagccgattgactgagtcctcgctggtgacatcgactttgaagggcgtggctctgaagcttgggtttctcgcggcggcgagggcgctggcctcggcagccactttggtcgccgacggcaagtcgaggtctgccacgatgaggcccgaggcgccctcctcggcgaaggcaatggcacattcccgaccgataccactccctacgcggcaattccaggtaagccaatggttacaggtttaggagctgagcgcggggatgaggctgcttacctccgccaacaaccaaggcaaagcctgtaatgtccatggttgagggctaattgttgctgatcttatggaactgctgttgcaggttgaggatatcggtccaaaatcatcgcagtccgtctaattgtcaagacatgcggatatttatggctgtagaaggtgagtgcaccggtgttggggtgaagaccggtgattccataccaaaagaaacgccggtcaagaccgaggaaaagtctatgagcatgggttatcggatgaaatgagatccgggcattggccattacaatgaagaaagcatcttagttcactttaaaagatatcaccaattgatcgttgtattgcttggctcgatacccaatccgatttgaccagaacaagttcaacaacatgcagttcctccaacaataccactcgcagcagtcgccaatccgcatcattcacgtgggcgcgggcgctgcgggcattctcagtgcctacaaggccaagaagctcctccggaacttctccctggtctgctatgagaagaatgctggtgtgggaggcacatggtacgagaaccgctacccaggctgcgggtgcgatgtccctgcccactcctactccttcacattcgagcccaacccggactggagcggcttctatgtcggagcggcagaaatcctagcgtatatggagaattttgttgagaaacacaggctgcgtgacttcattcagctcgagacagctgtgatgagcgcggagtgggatgaacccgctggggaatgtacgttcaagcaacacacttcatcaagtatgcacacatgatttacatgagccaccaggggtagtagagttgcagcgaaaggatggatcgcgcttcaccgaccgatgccacgtgcttatcaacggctctgggccactgaacaaatggaaatgtatgtatgatgacattctgccttcaatgcaagatgagtcgagcagttgtgataacagcaaacagtgccggatatccctgggagagaaaagtacaagggaaagttatgccactcatcgagctgggatccaagcatcgactggacgggcaaacaagtggcagtgattggatctggcgcgagcggcgtccagatagtacctcagcttgtaaaaggtcagtctacgaaacaaagaggcgagatcatagaatgaaacactgactcccagctcaataatccaagggtccaagtcgttaacactcttcgcgcggtcaacccaatggctcacgcctcctctgggcctccaggaaatcaccgttccaggcgttgaggtcaaccaagctcgtctgcccggtccactgggaaagcacctctacaccgatgtggagaagcaggcaatgagagacaatcccgaagcgctgctgcaataccgtaagcaggtcgacatggagctccagcgctggttcggtgtgtttctgcgagactctgcgctgtcagctggagcgatgcaggtcatggccgaaggaatccgtgcccgcttcggccccgaaaaccaggagctggctgagagctttctgccggactttggtcccggatgtaggcgcaatacagtaggtgaatggcccaatattcggtgcaaccaggatgctcactgtgcgtagcccgcggagggtttcattgaagcactcatccagccaaatgtaaccaccatcagggaaggcattgcggcctttaccgagacggggctagtcacagaggatgggcatcagcacgatttcgacataatcgtgtgctgtacagggtttgatgtcgcgtacacgccacacttgtaggtttggttgtacatgcgaggtgaatgaatgagagcttgctgatttatttgcagcccagtgaagggtcggagaggagtcctgatgagagaacagtgggcggagaaaccacgaatctacctgacagtctcaacgcctgggtttcccaatttcttccatattggcggaccaacagggaactggggatcgggctgcgtcttggcatcggtaagcacgaaccaagagcgataaacgagtcgttaaggggccaatcgggatgcagaatgaccgagctgagctaacgattactcccacagcatgaggtccaagctgaatatgcgatacaagcctgtctcaaaatgtctagagagcagctacactccgtcgagcccaaggacgggcctacagaccagtacatggcacacaacgcagcctggcatgcgtcttttagccactgggctgatggctgccggtcgtggtacaagaacggggcccgtgctgacggtgaggtgatgctatggtgcggaagtatgctacacatgatgaagacccttcgtagcccgcggtgggaggattacaagatacggtaccgagaccaggggaacatgtgggcgttcctggggggctggggaagaagcgagatcgaggataaagccgacaaggggctacccacggacttgagtccatttgtgcgaagcggagatgtgccctatgagattgagtaatcaactggtgtgtgtgtggtatccggtcagctccgcggaaatagggcctttacccccgagaggtttcgctaggataggcaatcagtctaacatggctacgagaaggaaagtgcttagcattggaagtcatatgctgtcacacccagaagaaaaacaaggcccagacgcgtgaccaggagtaaattagtagctgagaggcggcgataaaaacacggaggagtatttccatcgagactgtttcccgttttcagactagcgtctccgactgccaagtcaaaactatgggtctttcgccaagtgatccaatagacagccagccgagattgaccctaccctatactctgcttttgaagaggaacattcgaagatagccaagactgcaagatggaagcgtctaatatgtagtgttgttggttaaatgtattgtactcatttgaattttcaagttgaatttcaataaaccaggcttccaggctgtgatgtctctaaatgccgttttagatagatcgtcagccttttttctcaacaaccgtgggtatgaatctagcaagtgggtgaaataaaacatggcacaccaaagctctttccgcgcgagacagggacctcgtttttcaactaaacacaataagaagagaataagaagagaacaacaaactattctataatatttagcttgatattgtattcagtactaggttatttattgtgatattgtgttgaattcagtgctgaactatctcgatgtgccatgttttattttacccacttgtctagctacagcggtcactttgtagggctgtgatgggtcaaccaataacgtgcctagtcccttgcaatatgggtcaggttatgcactgctcgcttaccaaacagctgcacttctaggagtcaccggaggatcgaacgaacccgccaatagacgcgcctaagccccgagacccaccatcaccacttcccaattgagaaaacaatctatgtcccaattcggcaaagaatctccactcccgatctggcaaccaatctcacacatcaacgccgcatgacgaagcggaatggagtttaagtttgtgatgatgggatatcacctgaatagctttgcccattgttcctacctgtatttaatgaaggatttccttggctttcccaacctgcaatatcccatctcatccaacctcactttcttcatcgagcttcctcggtatcaatcccaactaccaactctctcacacacacatctacacacgcacacaatgtcgtacaaacgatctattttgttgacaggtggcacccatggcctgggctatgaggcagcctccaagctggccaaagaccacccagactacctcatcgtcgtggcctcgcggtccgacaaggaaaaggcagcagagagaatcaaccagaagctgggacagagcaatacccaatggatgaagctcgatctcagcgacccagacagcgtccgccgcttcgcccaacagtggattgcagacgcctccaaacccccgctgcaggtcctcatgttcaacgccggcctccagttccctactaccttgaccctcacccctgaaggcatggagaagacctttgccatcgctcatgtcggccatgccatgttgtttcacctactgtaccctcaacttgccactggtggtcgtgtggtcctcacctcgagcggcacccacgaccccgcccagaaatctggcttgcccgacgccgagtacaacacagcgcaagatctcgcctacccacccaagagcatggtcgacatccccggccgcaagaggtactcgaccgccaagctttgcaacgtgctctggggttatgcgctggccaagcgtctggccgagcgggcccctgagcgtagaatcaccgtcacttccatggaccccggcctgatgcctggtactgacctggctcgcgaggcaagcaagattgagaagttcctctggtaccatgtccttcctcgaaccattggccttctccgtctcctcgtccaccccaatgtccactcgcctgctgagtctggtgccgccctggccaggctggcgactggcagcgatgtggagggtatcaccggaaagtacttcgagagcctgcgtgagatcaagtcaagcgaagatagctacaacatagccaagcaggatgacctgtgggattggactgtgaactacgttgcgcagggagacgctgtggagaaggcccggctcgactcattgaaggtgtaagctacattaagctgttggctggttcggaatgatttggtgttgttgtcgcttttagcgaggtgtcatgtgtcctttcaaattcctattagactagcattacttgtcgaaacgactacttaatatattcttttgtctgctttgaaacaaatcggcttggcactatatggccctctgaggtcttattttactgcgatggtacacttggtagacatttcaaagccgggatggcttgtcggaggtcgcttagagtgccagcataaaccgatgtaaatcacttgaatcgtttaaatagaaaatacccgccttttaagataaaatttcccaattttgagtcttataaccgagtctgggtaactacgaatttgagccagtaatgtgtatgaactctcttggtctaataagactgaaccaatgaagccaaacacctacttgttatgacttctggatgtttatctatttcatggtctttggcgtaagtgggtttgtacgttgtctaggatgcttttgctccattattcttggataaggcgtcagacaaacagaaatagtgatgcatcaggtctctgccaacaagtttagtttttctcctctctcgcgcatgctactaatcttattcgggcgcagtgctgagatattgctccttgtaacgccaaaatcatgtaagcacaactgtctcacttgcttaacatggaccatgatttggtagtacgtgctaatctgtctttgagacgaaaccggcatctacttggatcttgagctagggcccaaagtcaatccatgggtaaaagggctgggccgagcggacctggaagggctgtcacacgcaatccatctatttggtcacttcggcgacctcaagattgtcacacatgtgttcatgaatattcataacaagagtcagggtatcctagtctaagtgctcgcatcatcagtcaacctcagccattcacacgtcagctcgcttcacatcccttccttgtgacatgtccctcatcgcacgagcccaattctacaacactgcgtgacgcttcgacaaacacagtctcacattctcggctttctcttccaaccagatgcgcatgtagtcgcacgccatgacttgggcggccgagctgcgcacacctgctgcctggtcatcctgcccgtctcggaagaaccgcaccgactggctgaagtgtttgagcagcacctcgaggcgacgaaagtacaaaacacacagccggagccgcagatccgcctcatcatcgtcctcaagctgtagtacaccccaggtaaggcgcggctcagccatggtactgtcttgatcgccgttcttgggctttccgccgatcccagcggctacctgaatacgaccatcagctgactgtgcggccctgttcgtagtcaaagctaagcccaggaaactgtcgtttccacgatcgtgatgtgcacccaaaatctccgagtgaactagcggttcagatgtacagttgaatagcgtttggtctccaaagaagttcatgatcggcggcatttctaacaagtttgaagccattgggcattccttggccctcttttgctgctgctggtgtgttgacggacaacggcttcctgtacttagagatcgccgagacggagttaagatccgcggcgcgtctttgtgacttcttcgcgaaagtccgtagatacagacaacgccgtttcgctcacagcggacacaggtgggctttgtctgagtacagcgcaccttcgactcatggcacgcgttgcaggacgcacggagtttgagattggccgtttccgtggtttcctcgttgttgatattgttactggtcattgtagaatacgattctaccttgaaggcctgatttcggtgtttgccaggagaaatgggatgcgtcccctgttatacgactctacttggagagagatgggtgcttcgtcttctcagaaatgggggcccagaacatgcctagtcttctattcttgaaagattgtaaccttggatcccaggatatgcagctattaccctatcacatacatactgcgttgtttgatgtggcgttctgaagcgtagccgtcaacatgcattgccccgccagcatcacagtgagcggccaatcacttaaagtgagcggccgcctgggagaatgaataagtcgcatattgttctttggtagtaacacaggctggaaagaccctgggtgggtgttggcaactcaagtctatttaggagatcaacccagggagtgaagcaaggccagccgcaacgacaagagggtgcaaataccctttccaaagcattaattgtgttgaaatgtcaggcctggcctcttccatggtttttttttcactttgtactcgaactctctcaccgtaccgtaccctttccaaaaaggggctcccgaaaccatatcaagttgcacatgaatacaatttattctatgctgggccaattgggaattccttcgggttctccaagtcctacctcatcacctgccgtgtgtgtcagcaggcaacccttaccacgttagcttcacgtgcgtgtattttgccgtattatcatgtatcacactaagcctctttaccatggtcagcaagatcggcctcactattatgccgtcctgcatctattggacggaactattagttcttgggtgacattatgatacctttggcatttatcgtgggaaagggcggaattcgttccgctataacgctttcaaaaagagggagaaaaaacaatctgaccttcatttaactggtaaaccattcctgaaattctccaaggcatctaaaaccttgaaagtctgttgtgtcgtatcacgaggcccctacaatggatctacgcgattgtggcccttttctggtcagaatcattggcttcttcgtgcttgtcctcgtcagctatgctatataccgggtcgtctacaatatcttcttccaccctttacgtgattggccaggcccacgctgggctgcagctacagactttttcaagctttggatcctacacaccaagcaagctcatacgctaggcatcaagtatcatgcccgttacgggccagtggtgagagctgcccccaacctccttgctgtggatgacccccggctactgccgttaatataccatcgccgtgcaaacaagactgatgtctacaccacgggcgtgctgggtgacttggctccccccttccaaacaattgactggaaagaccatgctcgaaagcgcaaacgcgtggcctcgtcattcctgctcagtaatctagtgaagctcgagggacaggtagatgctcgcatcatggagtggacaggagcgttggcctctcgctttgcggacgcaagcaagagcatggactttgccgcttggtcgcagtggtttgcttacgacaccatttgccagctatcctttggagaaccgttgggtttcgtccgcgaagcgcgtgatgtgttcaatctcatcaagaacttccacgacatggccccctttgctgccgtcgtaggggctctaccttggctttgtgcacctgttttgcagagccccatcactaaatggttgttcatgccgcgaccgggcgatagctctggtaccggcaagattatggcagtgagtcctcttaatcgcccctcgaaccttgatgacagctgcctccctccatgtcaatgtttgccttgccttgctaatgcaagtcatagttccgagacgctttattggaagacaggctgcgtgacccagaccgtcatcatgatgggagcttcttggacaatattatagcagctaagaacgaggatggtacccctatcaccattgaagaagtgaagactgagtgctttgtcctcatggtggcggcctcagacaccactgcggccttcttctgcggctttgtgcgctatgtccttcagacacctagcgtatacgaaaagttgatggcagagattgacgacttccaagcacgagggctcctctcggatcccgtccctacatttgaggagatcaaggctctgccgtactttgaagcatgccatcgtgagacgctgcgctaccaaccatcgacgccaatgatcatccctcgctatgtcagcgacggtggtctcgagctgtatggtcgtcatgtcccagccggcactgagattggagccaatccatacgtggtccaccgaaataaagaagtgtttggcgaggatgccgactgtttcaaccccgaacgctggcttaaagacccggatactgcgcgagaaatggacaaatgtatccttacctggggatatggccctcgtatttgcctgggtaagaatattgctctgctcgagacatacaagctcctgattcaggtaaatctccaactttgatccaattagtctgacattatactgatggacctgatatattaaagttttttcgtctattccgtccttcaatcaagtacccacacgagaagaacatttggcgacaagaaaatctggcactccttgttcattgggaattttggcttgatattgaacacagaaaacagcttgtatcatgattgggatttcagataatctaaaagaatagcaaatgattcttaggggatatatggggagggaactgaacgctagatggcatcgaagatacctaattagtaacggcccctagatagcaggagctaaattgtcaccagaattgagtcttcaacacccggacctttaagtgaagctcccacgtgaagaatgagccaccacattgggtatccaaccggcggttagaaatatgtactattagtttgatgaaaaccgccactgaccattccgcttcaaaggcttgaaaagggggggtaatattgatgatgtgcaaccagactttagacgcctcgtaagcacagccaagacgccacattcccatcttatggatgaagaggtcacgagaaccgcttttctaggcgaccgtgcaccgtatatacactcgcctgtccctgaaacgcgtggcgtctttcatctcttggccgttgagaacgtttattcgcccaatcttgcccctaaaaagtaatgactgagcccaaaaagacgagcaaagcgagcggacttatctcagacgctcctcctatattactccatgagattaagctgctctaagtggacctaagctgaggcagagacaaaacctaaactcaatgtttgatgtttgattcgtggtttggaggcgtctagacaattgggattacgagcttcgcgaggagtaccacctgaccataactgtgatgaagtaggatactgatccttcgttccttcaatcctccctggaaactcgtattgtgaagagctgagacccgaggtctagtatggatcagtttcagctttaccgtgataatgtagatgctgatgaaggcgggatttactacgtatataaaagggccctcagcgtgtcaatgaaagagattctactagccagactcactctcatgacatctcagacggttagaagcaatactctaagtcttaagcaatcatgagattcgctcctctcttgagtgccgtacttggcgctatagcagcatcggccttgccacaacagcagaatttatacgagctgtttaccagccctgagaacgcatggcatcgggacactattctgtcattccctggatctccggcgttctataatgccacgctccgctggaccccctctgccaaccctcagtattttgccgccatttctccggccaatgaggcagatgtagccaaagccgtaggttatgaacaggaatgctgagattttggaatgtcagaatagctaacatgaacaattaaatggtaggtgagactcgcaagtaatgcgggaattcccttcctcgcacaaggggggcgtcatggaatcgccgcgcagcttaacactctgaggaacggactggcaatcgacctctcaaagttgaatttcgtctcagttaatagacgcgctgctactgctcacattggtggcggggcccgattcagagacatctttggacccgtgggggatgctggtttccaccttcgtaagtcttaaacatgagtcccattagtcagttgcatgtcgagtaaactaataacatatcatagaaactggttcaggttcttgtcccggcgtcatgggcgttgccctgggtgctggtgtgggacgatatcaaggcatgttcggcctcgtgcttgataacctgctttcagcccgtctggttacggccgaaggaaagatcgtcgacgtctccaagtcgcaaaaccctgatcttttctgggccatccgtggtgctggtgcaaactttggtattgtgacctcggcagtatttaagcttaacaaggcaccaaacggtgggcaagtgctcaacgcggatttcatcatccctgcagcctcaaacagctcgtatatggacttgcttcagactcttgagaggatgccccctgagcttgctacgatctcttttgtcttgtggaatgagactatcagtcaggtttgttgctgccgaccctccagaaagcacttacttgaaagtaatggctaattgaataactcatctagccccagattcttgccaactgggtctacactggtccacgagagcaggggatgagactaatcgatccaatttttagactcaatcctgtccgtagtgagataaagatggttgcttggaaggacctcgtgggcacggctgggttcgggatggacggcctgtattgccagccaagcaacacgcagttcactcaaatctcgaccaatgtgcgtcgcctcgatgctaagacgttcaaaaccatgttttagaaaatgaacaacttttacagaagggttcctgccgctcgcgcaagtagcatcgagcttgaaatcttcaacactgatgccgccaagcgcgtgccgagggacgagacggcctacccatggcgtgacaccatcggctacaccatgtacgagtgaagttggacaaccgcagaggctcgtgaggaatgtatcaagatgggcaacgagcttctgcgggacttcgtggctacgtcgggataccccgatgtttccgtctacgtcaactacgccagcggcaacgagacggttgaacagaagtttgggaaggataagctccccaggctggcttcacttaagagaaagtgggatccaagaaatgcctttcgatggaccaatcctctgcccacgaagtatccttgagctcttggcctacgcagtttaactaaatagatcatcaattgtctcttgaaggacgctaagcaacgataacaaacgccgaggatctgtcctgtgtgttattatttctagttagtttgagaaagaaagaacaaataagttgcgccggaagccgtattcaagaacactccaatcttttagttgcatctctccctcttgagttgagggtgtattcatttcatgagaggtaagaagataagtatctgaagatatgtacggacgatagagaacttgcttttccacacttcggggattagctgtcaccaaaaaatagtgaaacctggaatgcaagtgaccttctatcgccgaggaggcgtcacccatgactggcctcggcgatcctttgcgcgtgtgacattacacctaacatgttccatctcctacgcttacatgagctcaatgaatgagtaagataatatcaaatgtaacggctggactttgttcagttttatctcgtaaaaatccaagcaaaactcaagtgctatttcaccgtttcagcacaataagggaggaaacattcggaggaccgcgtgctggtaccacagacattcaccattaactcaacaaggcactatgtacaggagacgactgtcgattatcacaatatccctcctgccaatttatggctggctggcgtattccatctggcgagactgggacgttgatcagaatatcagacgtctactctactacaaaagcaatgaatggcatgtgaataccagcatcatattcccggaggacccagattttgccaaagtaggttgagatgaaaatgcctgtgcagttcatgaagtactgacaaacgaagcagcgttcagaaagatggaccaatttttgtcagccaaaattctcaataattgttagtccggcaactgaggtggacgtggtagcaattgttagctcttcatggtataccgccgtcttaaagatgatagattgctgacgagacttaggtcaagttcgcaacagtgcataatattccctttatcgctactggtggtcatcatgggtattcaaccaacctcgggaagctggtcaagggcctggcaattgatcttagtctactcaactcagtcgaggtgtttacaggtaattccactttggtcgtcggcggaggcactcgatggggccagatattagatcctgtctacgaggctggtttcgaaatgcgtgagttccgaagttcaaacacacatcttaccctcacgtgataacaaaactcatagcaactggctcctgttcttgtacaggagttgtggggacaacaataggtggtggtatcgggcgctactcaggacgatatggcatgatcagcgattcgttgacctcagcaaatgtggtcactgcagatggccgactcgttaaagtctcagagacgttgaactcagacctgttttgggggatacgtggtgctggcgccagttttggcatcattacccaagccacgtacaagttatggagggtcgacagacagaatctggtgatgaatgccgactttgtcctcaattccgacatgagcaactcatacttcgaccttttggaatcttatgatacatcgatgactgagaatcttgctattgtctctatgatcatatacaatgaaaagacaaatgctgtacgctctgtataccatctccatctcatctttccctggctgattgtccaatcataggctcacattctcgcaaattgggtttaccttggccaggaagaagaaggtcttggcgctataaaacccttacttgaattacagccatccatatcatccgtctccatggtcccgtggaataaattgttagcttcccaagggctgggcattgtcgatactatgttctgccagaacaaccagacgcgcagcctctattcggcgaatgtacgacgttttccggcctcaacttccaaaatagcgttcgagaagatggaaaaattatacgctgaatatcctagtgccagagcaagcagcttgagtttggagatgtttcccaatcaggctgccatggcccaaggttcagatgcaactgcatatccatggagagacgctcggggcaacatgtaagtcaaatagacggaactctcaggcgtgagagaagtaaaataggtgctgactgtaccgccattctaggatttttctttctcagtgggaggataatggccatggcttaagcacagatgcgttggaattatcgaccaggctcggccagagcattcgagacgcttttgccaagacctcggaatatcaccaactatctgtctacgtcagttatgcacatggcgatgaaagtctggagcaagtctttggcatagagaagctgcctcgattgactgctttgaaaaagaagtgggattcccaaaatgcatttggatacagtcacgcgctaccgacagaacatcctccaatccgagctttagtgctgtagttgaatgtgtagctcggtagaacctagcgacaatatctctttcaaatgatgagaataactcaactattgtccttacactctccattaaacagacaatattcgcattcatagttctcaatcatgagagagaaccaaaatgctacaaccttttttcaaagtgaaaggataaaacagcccacagttcactgaacaagcgccatactctagtaacacatggtgaagaaaagttagtctctaaacctttcgtcccttctccccagcggtcattgggtcaaacaacaactaagccaattcgtctagtgactctgggatatgctcctctatttccgtgaaaaaataagccaaaaagtttattcgtaggccaaaatagcaaaagtagatggtcactaccaggatcgaactggcgacgtccgcattactacacatatcggatgatatattagtacggcactctaaccaactgagttaagcgaccatgccatatgagttgttgaatcagaccataccccgtccacaatacgaaccgacgaggcacaggcacagaaagtgattcttgtcctaaacagagagtaattcatttggcattcaaagtctatctccagggctattccgttctcatgccatgctctttccagtcaccgctagcaaagcttgatcatcctcttagtgcctatgctacatgctcaaatccgacaagctcaaagagatagctgaccatgtaaatctgtcacttaattcttaccgaaaccggtttggatgataaaattcgggcccaaggtaggacgtgatctcaaaatcaccattcttcttgaagatgaacccaacatatgtttgaatgccctttccctggtccagaagtcggtgttccgccaaactctcaagcacacggagaaaccccgtcgagtaagcaccacgacctcgagattccaaccactgtacgagagattgcgcaatcgtaccgtcatcagggccatactgtcgcactggaagatagaatttgacatcggaaatggtgctcaccgcacctggagccacgtcaaagtagaatatgtatcctcctttgagctctggttgttgggagaatatcgcctgtgtaggaggtgtccatggcttactggggatatcttctgtgtcggggtaatcttctggaagtccaagaagagtcaagactagagatcggagctccataaaattttcctcggggacttcaataaccccgccaagagtcatgatgttgcgcacacaaaggaagcttgtggagggtgagttgaaatagaacttgagtcgagccttgctgggatccacgtcgtccgttgacagaagactatcctcgcgtttattagaaacatccaaatagtttggtcgtgtattcacggaggtagcttacaagggcacaagatgtcggccgtaggagttttctcgagtaaatttcatcaaaatatcgagatttgcattgtctgggttcagcttcctgatagcagcgttccagaaatcaaggctcgcacggccaccccgactaccaagtgtacgtgaggaaatgtacgacttgatgcccagacctttgggactatactcaactgcgtgagccaaggtgcccacagcaggaacgccggcattattctcagcggcgagcttggcgatgtcatggtcaaacaagtgggctagaaagtggtgagtccaaccaaagtctgcggtaggaacgactttctggacttgatacatgaaatcccgacctggctgctgattcagaggatcggtcactgtacctgagcgctcattgatagtctctacgacatagcggatctcaggtctatcttcgagattggtgttccacttccacgaatactccatagatgatccgtcgatccccatgagagacttccacgtggtgctaccatcaagttctggagctgggcccaagtaaggggtctgtggcctagtcagatggctcgtgtctcgggagaaacgtagagctacttacgatcatatggtaatgaaacaaaagtgcctggtattgcttttctgttgagtagttggcgttatcaaccatactagcaaggtgaaagcctgtaagtctccaccaataatccaggtcgcggttccgatcgggtaggcattcttgggcaagagacttccacaccttgctcgcgttttcgcgtttaagcttggggtttatctcggtcatttttatcaactaaatgactttacctcctccagataaatattggttgtttgtccagcacttatcgttgatagtcaacatggtttatatgacaatgatgacggtgtgtgttatttgtagaagacttttctttgtcccattcattactatcttgagagatgaagttcatttcctggaacattgtcaatggcaagtaagatgacgacatcggctattgagaattcaccgactcggggctgtggcgtcgtcggagaagcatcgccgactggtagcacgaggcgcgttgattgatgtcgccgaagtcccgagggtgacatttgtcctcgttgccatcggacactttccgagtatccgaacccaatatcctgtgtgagtgacatcaagtggtttctgagtggaattgtcttgcgtccctcgtgaaggtggagttcttttccctctttggatggacttttgtagacgaagcatacttcaggaaagtatctcacttttgacttacaagagatccatgacctcgttgaaaatattatgttcgtttcaaggagtagtcaaaaataatagcgctcttctcctctaggacttaacgccatcatgcggtgagagaacggcaaagtcagattgggggtctattaggcctatttgtaaggccaaggccccttattggatgatacccagacttgtgccatttgatacttgtttctcgagggaaccaaatttgaaatctattaaggccacgtccactgttaatagccgcagctgggagcggcatgaatagccgaacagtcttggctgtagcctagctgggctgaaggtttacgcgttcccttgttgaaacttgttgatgtattcaagtgaggcgaggcgagtggagacagccatgtgtgcactaacgcttgatctagagctggtcgattcattgaacctcatcgagaaacatgctgacgtggaggacagatgcaggaatgtgaagacaggggctgagtgaagcttataactgaagggacatgcgtccgtcccccacgaaatgaaatgcggctggtatcaaatctcggccttgcatcgaatgaaatcaatacattgaggcagcatgttcagctgtctgactaatcgcggcacggggtaatatttggtccgagaaccgctgcagagtccgtagaccgaagagcgaaacccaccgctgaatattatccccgtccgcccagcccgccggtaacgtgggacaaccaccagacaggcagttctgaccttcaccaagtatcgctaacaacccccaaccaatcaccatggcgtccctcccgcgcaacgggcccagtgtcaagatgaacaagacctgcgatcagtgcaggcaccggaagatccgctgcatcggtgagtgcgtcccgcccagtaccgtgcttcgagcatgcgggggcctagccctgtgtcatgccacccgttgttcgttctgatctgatctgatttgtttggttagtacccgaagcgcccccaggaacaccccctacgtgcatatattgtgcggtaagttcatttgtgacttgtgcctgtcgttctagaagagttccattctgagatgaccccggttggtttttctagaaacgcggacagccctgcaacttcagtatctttagacgcaaagtccgagtcaagggtaagcataatcgagtctactgtccaagtcttgctcctctcagactacagcccttaggctacgtccattgtatattgacttgaatgccgaaatagttcccgaggctcttcccgccgccactcagtcccactgtaaggtggccctcaatgacatattcatagacagagtcctgcagcatggcccacagagtattaccctcgctgacgagaaccgggtcttttttgtatgagataatttgaccctccctgaacctccggtgcttactatttcgtctaactcccaacgacccaaagatctccgacgagcaaggtataataatttcacccaaatttcaaccatgtcggtctaatctaacctgtgtggccgatgtttagttccgagttccggtctagccttcttttctgagcagaaagttgcttcattagaagacaaagttggccatacccgacttcgagctctcattgagaaacttgatgaccttgtgatgaaccgtctacgccaatcaaattctccatcaagcacatggccctctattcagttcaagaagccacaaaaacatgaatggctttctgctgacatcgcgcattcgtacattcagggtaagaggagcccaggaatcgtctacgactaaacgactctaacgttgacatagcttacttcaagaacctccatccattatacccctttctagaccgcgaggaatttgaaattaagactgctgtccctaatcttaccgaagttcttgccatcaacccccagttttctgctctgtatcatgctatcctagctctgggcagccaatttcttcagggtgggacattcgagcctggtaaaggaaagtcttgggagctgttccaagtatccttgggccacatgggagatgtccttcttcctcgggaatccatcgaaaatgttcaggtttgtcttgttaagcccagtcttggctgccactcgttgacgatttgactttcccaggcgctgactgcaatggtaagacttctgctcccgtgatattccgagctgtcgccaattgccatgcctatgcttaacttctacagtctatctatgccatgaacacctgcgggcttccagtcgatgacgtattgatatcacatgctgctcgcatggttctcaccttacgatatcacaagcacattaattctgaagataggcaactgagggtgttttgggttatctacgccttggagaagcaaggagcttgccacagtcggatagcttcggtaagttcccatccactcagctcagtatcgggaaatctaatatcaaacgtagttaattgcggatgaagacattggatgcatgatcccgccctttctggaagcgcaattcgacggctacgactggttcatcgactttatccggatccagcgcatcacatccattgcttacacgtcgcttttctctgtgagcgcctcgttaaggccggactcctcataccagtctaccatggaccaggtccgtcggatgctggaagagtggcgccagtctattcccatcgaattcagaccaggggactcgtcccacttccccaagtcagcacccgtcagcacacgtttggctgctttgcagctgcatttcagctattacaacatcgtcatcggactcgagcggctcacacttcacctcgatcagaatggaggctacaagtctcagttgagcaagcagaggcttatgaatacggcgcggaccattatagagttgacaaagtacattgaagttcagccctatgtaccggttttgtaagaccccatttgtctcttgagctatcctagcctaaccatttatactttagcattttggccgtcctccctgtatcagctcttttcattctctttgactttgtgcttcacaacccgcaccatcgcgagtcgagaccaaacttggtgttaatggaccaagtagctggctactttagcctcatcgggttcgcctcaaatcaggctctcccaggaactttgatgcccgagtttagccaaatcgcaagagagtactacgccaaagcgcaacaagagttggcggatcagaaggccccttcagctcataaagcggaggagcaaccaccccagccacctgtggtgaatcagaattccgatcagtcgcaacagaaacgagagttatctattgaccctaatttagaggtgatgagatgattcccatgtctgttcattccaaattccgctaaccggtgtcattaagcccacctcaacgccagtggatcaattgcaggactacaatatgcatgtgggcgcatcgcctgttgactacttgaactatcccacaccgatgaactttgatgggccctcggatttcacaatggctgattcaggtgacctgaggaccatctttggttgggtgttcccagattggaacatgaatggggtggaaattgagtctctgagtctagacggcttgcacgaaggcagtggtccggtttgagtttgatgaaaagtcatgacgagttactccatagaccaatctacgctattacaccaaagccctattgtaatctttgttgggcaattttcatgacacctttttcaaatccttgaggtcaccacatccaacccaactacattacatatgtgcaccttgaggcttcttaaaatgggaaatttaacactgatagtcctatacttttagaatatgaaactttggctgattgagggtcttttttgcagctttatgatgctatcgctatgttgttgtggtgactgtttgactgagaagaaatcttgatcattaaaaaagattcaaatgcaaaaagaaaagtgcgatggcggggaatcgaaccccgatctagtgcttattcttcctatggaaggcaccaatgctgaccattacaccaccatcgcttgttcgttgaaatctgtgtccaaagttagatatatattgatcaaacccagccctagtgcttggaaggcaccaatcctaacctgcaaggatattaatcatctagaatccgattttgtgggtgatacagtaacttaccactagactaattacgcctcttagtcgacagggagtttaaatttaatcaataagtaccagattctcctttcaaacttcccatttctcagcctgtgcagaaaatctcaaccataagaagaccccgcaaccccaaccccaaccaaaccgaatcagcggttttgcagaagtaagataataaacaaaatagctatgctgcaacatgaaacaaagcaaattgtcctatgaacaaaagaaatgcttgacctagagcatggtttggctaatatgtagtgataatcgaagaactatttccaaagaaccatacagcttccgaggtatgcccaatcgacgcgaggatggaatccatcatgctagaaatgaaaatgcagaagcataacgactttcaaacaggcttgccaacaaagcggggctactcgaattcggcttccgtccaagtcgggagttcgacgtttgcgggtactggacgagcctttctagaagctggcttattgccgacaacgagattttggaaataatcccacccaattgcctttttgcgagggttttctttttgtatttttgtatgattgagatttcatcagttttagctctgccagtctcgctggttgttttgttggagttttacaacccttttgataaataacgtcagcaaatcacgcggtgcatacctagctgttgctgtgtttattaaatgaatatcgcaaaaagatgtaagccattttgcgatataggcatgtagagtcctcttctgtccgcattagattcgatagttgttacacgtacaaagcgaagcaagtcttttgactattgcatgagagcgaatttggtaatatagtgtgcaacactactggctctgttggtaagactacttcatcaattgataagttattaggtagggactgcctacttttatcaggattgaccttgaatcttaaggcgggaatcattctaatcaacgctatagggtagttcaattatgcatacataaggcaaggtaaagtaggcgactgttatcgccgggtgcggagtagcgacggtaaccttgagacaacgcagatgggcagccttgggtgattacaggtagccacaacaggcatctgcagtggacaaggtgttccccagcacttagttttctttacctgatgtccttgatcaaatgctgcaacatttttcttttgattcttgcttagatgcatgcgaaaacaacaagtacctttgattgaagtgtggggctgggaggtacgtgattaggtaagcacgtctaagcttggcgcgcttgcggctacttgcactgatcatttccaagtaataccacgcccgcaaaactccaagaaaacaaccagcgagactggcagagctaaaattgatgaaatcttgatcataaaaaaaagaaaacctttgcaaaaaatcaattgcgatggcggggaatcgaaccccgatctagtgcttattcttcctatggaaggcaccaatgctgaccattacaccaccatcgcctgttcgttgagatctgggtccaaagttagatatatattgagagcacagaccatgcctacctcactcggccgaaatacctaccattacgacctatatactggtccatttctaagagcctgaaagaaggggttaaaaaaatcttaccatcaggcgtatatttaaaaaccggccaatgagccggttatagttggaccaacaatgtcggcaccgtcaaatcgcctgttgatgctcggatgaattagtaggaaaactgtcgcatgtgacattaatgtttgtcgactactggagcagtccctcttgcattgctctttgtgtaagagagaagaaattatcacactgtggcctgagtctaacacgatgctgtttgtgcataagttgaaaatgttgtgctgtcccgactcactgtattgatggatatctgagcattggataatagctaacaactcttctggggaggttaaaattgctgtgctcatgcatggtgggaataaaaatgtcaccctctcttctccgtcacaagatgaaccatggctaaagttcaaatgctggacagtgaaatcaaaatcgcttgccgccagggagccagccagtgggaggcaagcaaagtataccgataggacttttcctttccaacttcgatacatttttgacatctggtgagcatacaatggattcagctgcactttcgcgctgacgtcagatattaatcacatgtccatgactcatcgctagcttatttactcattgatacatgtaatatcattacttaagagggtggagaaaccaatagggggatgcttgcaatatatagcccaacccagctcatgtaaaatgctcgggagagtccttgaattcatgcaaacaaacccaaggtcttgcgccctttaactaagaagtaatggctgaaaggccaattcgagctatacaaccttttatcttcttaatgtaggacatggacttgaccaagacctttcggaatccaactgtttctgctcttcagaatggctgctacgagtagggtcgccatgagtcgttctagataaagtgaaattgctgtgctatgcctcactactgcctcaccatatgcttattggcagtggacatcatcggggaagacttgacaactctttgggggggnnnnnnnnnnnnnnnnnnnnnnnnnnnnnnnnnnnnnnggggtaacaaccgctgtgctccttcgcttcacacagcttcacttattgattggccgtggataatcgttgggtcagacttgcataacaactcctctggggagtttaaaattgctgtgctccgatcaggatgcatgctgacctctgtttgtaggtcgatctcccctttttctcgcttctcatccttgggagcttagtgctacaagcagccatgattttaatggcctactctatgttgttgtgatttccaagatatatactcgctccactaggctatctaaattattaaaatctcaagttgctgtagaaattcttcgtgttttaattactactctctggattctatgtttcgtgaactgcctttgtatgcgcagcacctattgtcatgtaacctcgcacattaacctggctggcacagcatcacatccaaagggataagcatgccaaggcttcaagctttttgtcattgtagaatctatatcattaaatcgaaagagtgaagttaccggtaacgccatcgtgatttatctcttcccaatatgaggtaacatcaataaaaagatacaagcgacgcacccattcaaattccttctgtagagctcgagctaatcttcccgtgttgagcatccttctgatctgtttgttctaacgactgaagcttcacaagctcgtagtaacgcccgcccagcgtcatcagctctgagtgtgtgccagactctaatacacgtccttggtcgatgaagagaatgttatcagcatgctggatggtgctgagacggtgtgcaaccgttattgtcgttctgccctttgctgccctgtcaagagcaacctgaacgacatgttccgactccgaatctaatgctgatgtggcctcgtcgagaagaagaatcttaggtaaccgaacgagtgctcgcgcgatggcaattcgttgcttttgtccagtcgatagtaagccaccacgactcccgacgatggtatcaaagccatccggcaaggagacaacgaagtcatgaatgttagcttccctgcatgcaatctcaattgactctttggacacatcttcggtgaggcttcccatacaaatgttctccctaatagagccctggaataacgaaggttcctgactaactacagaaatatgcgatcgataatcgttgatgtttacttcggatatgtcctttccatcaacaagaatttggcccagcacaggatcataaaagcgctcaatcagagagatcgttgtactcttgccacaacccgaggagcctaccagagcaatatgttgacctggttctgcggtgaagttcaatcctcgcagaacagggatctctgggcgcgtaggatagcggaagtacacgtctcggaattgtatatgacctccggtctgagagaggctctctccttggttgccacaggtgtcaattaatggttttgtgtcaatgagtgctttcaactctgcagccgacttctttgccttgctcaagtccggggccagcgaaaagaaggtgccagctgcggttgctccgaggatcatggacatgtagcacacgaagaactcgaacataccatattcaagcttggcgatgagcgtgcttccgtaccagaaaccaaggccgtagcagagatattggatagattgagccgcggcaaagatgacgctcgacttggcgactgacacgatgctcttcttctgttgctcttcaagatctacgcggtacttctctgcgacttggctctcccgtgtcagagacgcgacagtcttgatcgcggagatattctcagccgcgaagccagccgagtcggcatacacggtggcaatgcgagcttgatgccgggccagcacccaccatctgaagaagccgcagccgatcgccaacggcacggcggcaaagcagaccaaagcgagcttccatccaatagcgagggaaagggccaagctcccaaccaggtttgtgatggaggtgacgactgtgccgagggcgacaccgctgaagccagacacttgggttgtttcaacggcaaggaaggccgtcaaggctccggcgttatgcttgtcgtcgtcaaagaaggagacgtcctggcgcatgagagtagaaaatgtctgtctacggatacggcggagcagcacctcggcggcatatcccaagatgcagagctggatcatgtgggagatgaactgagcgccgccgagcatcaggtacatgagggaccagaagttggatttcgagtgatacagccatctgtctatacctgggatcgccatgtaagacagcaccactacctgcttgccgaagaacactgaaggtgtgattagttagcacggattggccgggaaagggatgagtgctgtcaacggagatacttaccagcttggacgggagtggctgcgccacaaataaggcagaagaagaaggcgatgatgagataaatgcgctctgacctgttgaagcttgcaacgaacttgatgagctcccaccaggaatagttggtcttgctctggatggtggcgccggccgtttcttcaacgtcgcctgtggatgattcagccgctacaccatccttttcagaggactcagcggcagtgacattggtctccttctgcagagacattttgcggaccacaagatcctcgatcgaactgacttgatcatcagtatccacagccgtcgacttcttctggtcttcaagctgttgcgcttcgacgagggcgtggtatgcgccttgcttctggataagagtgtcgtgattcccttgctccacgacagttcccttgttcatcacaataatattgtgtgcattccggatcgttgaaagtctatgggcgatgacaattgtggtacgaccggccgcggctttgtcgagggctgcttggacaacaccctcggacttggtgtcgagggcagaggtagcttcgtcgaggagcaagactgcggcagtgattaattcatgatgattgacaggaagttggggaggctatagaaagaaaagacgacagggaacataccttttgggttggatacaatggcgcgagcgatggcgatacgctgtttctgaccgccggacagtaggaaccctctttgaccaacattggtctcgtatccttcaggtagctgggtgatgaactcatgggcattcgcctgacgggcggcgtcctcgacgagctgccgctgcttctcctcatcagccgtctcatggtcggttccgataagcccaaaccggatattgtcatgaatcgagacggcgaagagcgtgggctcttggccaacgagggacatttgctggcggagccaccgtaggctcagcgtgttgatgttgcgatcatcaaggaagacggcgcctccgactggctcgtagaatctctcaacgagaccaacgattgtactcttgccgcagcccgagctgccgaccagggcagtgactttgccggcggggacgtcaattgacacgccatccatgacggtgacgttggggcgggaagggtagatgtgcttgatgttttccagccggatgtggccctgaaggtctgggattttgtcgccctcgtcagccgacgggtcaagaggagattggcgatcaatcgtcctgaacatgtccttggcggcggagacggcaccgataaatgactggaagtagggtcccattgcgctcatgttgaaggcacccatcatgacagccatcatgacagtaatcatcttggagattgtcaggtcgcctcgtgcaagaaacgcggacccttgccagaagcccagcccgtagttccaatacgtaatggccatcgacacagccgtcatgacagaaatgctgtacttgaccttagtaccccatttctggaccggctccagcttcttgtcgtattgctcagtcaagcggccctgcgtcccaaaggcgatggcgatccgcacggatgagaagacctcctcgacgaatgtgccgctctcggagaaggcagacatcatgggcacgctgtgttttaccatgaatgtagtcgcaacgcccgcattgagaagcagcgcaaagagtgtcgcggacagaataagtgtaagcttccacgagaagatgaagccgatggcaaacccggttacgaatgtcgagatggcgctgataaagagaccgaatttctcggagatgccatcctgcacggtcgtagcgtcggcagtgatctttgtggtgaactctcctgtgccgaatttatcaaagtagccaatgttctgacggagacagctcgccaggtactcgtaacgaatcttgtcagtgatgcgttcgccggtatagatgaagccgacggtggaaatgtaggatgcgacaaaggtgccaatggcgatgtaaacaaagtacagtacatatccggcgatggcagattcgaagccgcccagatccaatgtctgaacggagagataatcggcgaagacgccttggagaccgccaaagatgatggtcatgagcggcagggcggcgccaacagcggcagcacacacggccgagacgatcatgatgaggatgtccatcctagtggcgtagcggaagaacgtcgagacgccatagctctggccagatatatcaatctgccgtttgagaatagctatttcatcgtcggggaggccatcaaatgggtcaggtggctcggcctcgtctgcatttagagaacctggaggaccctgaacattttggacggcgctgtctgctgtcggggaaggcattttcgcaggttgatcgcctattttctgtgtgtcgctagagacaacaacaacaacaggtccgggctgaatgtctgttggcgaggaaggccttgtagttttcttgatatcatcttctgccatgctggtcctcgatgtgattgaccgttcttgggaaaatgaagggccaattactgtcggcgcaggaagagccgccggactctctgatttgatgttaggttctgatttacccaagtcatctcggccagtaacgcccacgtcttcgccactggccagatcggcaccgtcatcgtgtctgtcgggcatcatggagtgcgtgggctcggcgctggcgttacacctcaaatctactggcttagactcggcagtgggttcatcatgatcctctattgggcgagtcaaaggtgcctttccaatgtcgtgttgagtcgtcgggccgacgagagtattgtcaacgttctcctcgtcgccagtagctcgcctattctcctccgacaccatgttacctcactccaatgccggcaaactcctccgaccaaagttgggctcgaccaggtggttctcttgcgctggctgggcaggatttgggaaagaactgtctcagtgtgatggagagccaggacaaaacctagtttcacaaattgctctcggagggtagaatttcgtagacctagaatcgtttaggtcgatgcggagctcatcctgtacagataattcgacgcacgacagtcaagacatgttcttcattgtgcaggtgagaatagcaatggagcaaaccgccagttgagcggaccgtaagacagggggcacagtcctgaccagacaggggctgactggtaagcattccccggaatttgtgggcagactatgtaccctcgttcaggcaaggctctgtagacctgccattacggcacgcttccgacccgtcacacaccatgtggcctgctttggagccctcgcagtggatagcagcagctggatgtacatgaagcggcaaggcgtcaaggcgcgtccatcaaaagtccttccccataactgctccgagactctgtccgagaagagacatgagaaaggacgaatcacctttggatcagccgacggacagcaatatgacggccataggttccccaactgccggtgttccgttctcgacctgcatgagcagctaaggaacgagtgcatattcaagccttccgcgtaaagtaacgagcacggtggtaggtaggtagcatgcatttacatttctcgtggcactcaaagtagactttcatcattctccctgcgacgtgtcatccctgtcagttggggaccacccacttgccgcactacttaactcatttgccggatatagctgtgatctgcacacacggagaggcgagcaatacggtagttgacaaacagagaaagctaccgtttactatcatcctgcaaaggcgtgagtgaagggcaagaactgattcaccggctgagcccctgctactgcagcacgcagccgctcaaaagatcgcctcccgtggtagcttgtacgtaataactgaggcctccttggcctcctaccagtttcagcctcgagttcactcccgtaccgcccggcaccaacttcacccgtcttacacgcgccaggacagggatcaaacgcgtgggctgttatacagccttccagacatccacacaggcgttttgaaagtgacgacacgcaattctttacctaactcactctccatagccctgatggtcaggaggggcggtaaatgtctgggactgtcttgtgactaaaaatcggaagtacttcttttgtgggcctgttggtatgctagttcgggtacctatgactactttattttgttcagcttattctgtcaaaaatcagaaggagaggacggacaaaacggcaccaattgattgatatcttgaatagcccaagccgtatttgtaaaaacgtaaattgccgcctttctcacgtattcaccttaattcagtaatgataatcattccgtatgctataacagtcatctcaactactaaaataaaaataagcactggacaataccacggtgcttataataattcccaggtcgattgaagaggcacaggacctgtatagggtaggctctctcctgagctgaaaacagcacgacagagcttgcagggatcaggcatcaggccagcagatccatgatcatccatcccaacgcttattaggcgcggcggacgaaaaacagcccgtcgagaagatcgcccgtcgctccactcaggaacaggcagcttcccgggtgtttattccatcatcccagctcgtgtcggaagcggagggacaggctcgcccacccattccgctgcttctgacctcattcttattttggcggcagcgttgggcgcttggcatttcactggaatgttcattcgtgtcccgcgttccatcccacaatacgagctcagacagacatgcctagcctctgtcgagaggtctctggcagatcagcctggaggtgtggaggatctgttccgatctaacgcacgcccccccgtgactggatgaggatgtcgctggtttccctacggacctcgcccgtgttaaagggaagaggcgtgtgcccttggtttagtttcgttgggctgctcgcctagcatgaactggacccctgccctctcttactccctcagaggcccagacagaggcgggaggtcagaaggtcagatcgcaggttgcatttacggtaagatcttggcattcaccgtagcattgcagcgtcagggtcggaataagacgaggaaattttcacttgattacttactttattacaatttcctggagcctccggcagctggcccatctggtccctatgccgtcattagaagctcgcctaaataataagctcggccggaggaatatacacacattgcttatagggccgctgtggcaaggtccacacttctggtaggaccattgggcaactggcacgggttgtccgcatggggagagctgaaagggaagactggagtcaaccgcatgcggtggttggcgttgtgtgatgcctttcgtctggaactaggtagttcgtgccaggttctgggtagagcaatggtgggaaagaagagaagatgttcgccatacaagggtccaaggggctttgtggctggctctcccgcgttgaagggccgatcatcatgcatgtctgaccgaagggctccaatactcggaacatcggaagttaggtcgagtctccatgatacaccacattgccattgaggtgtgtgcctgttgtggtactctatgctgtatgctgtacctgtgtgcaagcctgtctttcagctacagtccattgaaggcccgatcttaccttgcctcccgggatggtgaattctcatgtacctgctgtgaccataccaggatgagccacctgcccgagctttgaatcatacggccgggattaattgctcatcatagagattccgagcctctcatgtttctttgtctcttgttctccgacccagtctatgcaaagataacagcatagaggcacgaggaagcagtattttcccgacacacggactttgttgcctcattgagcctttctcattaacgctctagcataccaagggaagaaaacaacaaaatcgacttagataaaacttacatacgtgaagcttctcccgacgaggcttacacttctgccgccaacggcaaccagcataaccgaaacgcattggaacacactagaactcaaaaaacagaacgcccaaagaaatcaagatgggtgtcaccgagctcattgaggctcagaagtactggcgcacccacctagcaggcgccaaagtggctgcattccctccccaggacctgccatgtgagactggtgtaagttcctacaaccacgatctccggttttcattcaaggaaaatgaattctacaccagaaatacggtgctccgggccgcttgggctgtagtaatcggacgatactctgaatcagaggactttactattggtgtttcggcttgctcctccggcgatgccatcccaatgcgctttagatggcgcaaatatgataacgtctctgatatcctgagagacattcaattggagatggatcaaatggcccaatatgagcagtatgggcttgagagtatcgcgcaagtgagcaaggatgcacagagcgcttgcgacttcaccagtttgatggccatccggaccagagacgtccaggccaaggaggaatctaatctcaagtacgcgctggaagctcgaattatcatacgcgaggaccatgccactatcacactgacatctggggtcctttctgaggtgacgcttgaggcgcttgcacatcagttcagccacaccgttgatggcatcttgtccagtcgggatgccaagctgagtgacatttcaattgccggtccttgggatctagcaaaggccaaagaatggaatcctcacccggctccatcggtacagggctgcgtgcatgacttcatctcggacagaacagccaaaatacccaatcatgaggccgtatactcctcggaagggagcttgacttacaaggaactggaggatctgtctacctgtctcagccaccacctgaagtccctgggcgtgggatcagagagcattgtaccctattgttttgagaagtcaatttgggctgttgttgcaatgcttggtatcttgaaggcgggaggcgcctttgttcccctggatccttcacaccctcccagccggcggagagcgatcatcgaagagaccggcgctcgaacggtcatcacgtcgcccgcctccgcagccacgtgtcaagggatggccccggtactcatcgaattggatcaggcactcctcgacagtttgcgcggcaaccatgttttagatgaactcccccaggtttccccgcgtgacgcagcatacatccttttcacatctggctctacaggcaagcagaaagccattgtcgtggagcactccgccctctccgggagtcttctcggcttcaaccgggcctatggcctggatggggagtcgcgtgtgcttcagttttcaagtttcgctttcgatgtgagcctgagcgaggtgttggagactctggtttttggagggactgtttgcatgccgtcggatagacagagaatagagtctctcccccaatttattcaagatgctaaagtgaacacggccatgctcacgtcatcatacctcaaggccttgaagccatcagatgtgccctccatccgcgtgttgttgctcgtcggcgaggctcccacaagagacaccatccagacgtggttcccgcacacgcgactcattaatgcatatggcccgtctgaggtgtcaatatttattggctcatatgagtatcaatcccctgatgaccaaccgaccaacgtcggccgagggttcagcggcaatatgtggattgttgagcctgacaatcacaatatgattgctcctgttggttgcattggcgagattctgatcgagcgtgacatggctcgaggatatctgaacaacaaggaacgaactgacgccgcttttattcgccaagtggacttcctggacacgacgtcgatggatgcggcagtcaaattccataagtctggtgatctggcacggtataaccctgacggtactattgagtacctcggccgtcgtgatactcagaccaagttaagaggatatcgtgttgagctaggagagatagagtataatattcaacgctgcctcggaaacgttgagtatgtggctgctgatgtagtcacaatgggctcacagcccactcttgttgcgttcctgagcttcacggacgtgggttacaacgtcgaaacagaaggtcaccaccttcctgagaactttggtatcccatctgagagtctcaaggagcggttcgctgccttgactggcgtcttgaaagatgtgctacctcactatatggttcccacaatgttcttccctctcaacaagatgccattgaataactctctcaagcttgatcgtggtaaactgaagagtctctttgcggaattggatcaagagcaactgggtctcttttcgcttaccaaaagggcaaagcatgagccaaccactgccatggaatacagacttcgatctctgtgggcgcaggtatttgcggttgaagaagagcagattgctaagacggacgacttcttccagcttggtggaaattcacttcttgcaattgaattcatgtctttggcccagaaacagaatcttgctctatcggtgacggatgtgttccagcactcgaagctggacgagctcgcattgaccacagttgagcaagccatggacacatatgatgctctgccattcagtatgctgtctcttccaaaagaagacctactatcagagacaaagaaatacgatctgagtgatgtggccgtggttgaggatgctttccctgccactccaattcaagaagccttgatggcacttaccgtccgccagcctggctcatacttggatcatcttctcttcgagattagcgaagttacggacattgctaagttcaagaccgcctgggaccaaacggtccagatgtgcggcaacctgcgaaccagaatcttccaccatcaaggcgaaactatgcaagtcattgtgcagaacgataaaacctgggacttggccacgggagcctcgatgcgcgagtttagaaagagcattgagagacagcctatgggatatggcaccaggctctgtcgttatgctgttgtgaaggaatcaggaaagcactacttcgccctcgctatccaccatgccgtgtacgatggctggaccatgaatgtgatgctccgaacgttagttcagaactacttcgggcatgctacttctgtccagccatattccaggtttgttaagtacaacatggctattggcgaggagacccagcgtagctactgggagaagtatctttcgggtgtgtcacacaccccttttcctcagaacagtacatcggcagtgtgcaagacgcaggcgagtgtcaaggccctcagattcccaaggtcaaccagcagtacagtcaccatggctaccataatccgtgctgcctgggctattattgttggacgatattgcgacacagacgatgttgtatttggtatgacaatgtctggccggcaagcacctgttcctggtattggtgatattccaggtgtggctattgctactcttcccattcgtactcgccttgataggaccagattggtttctcagtatcttcgtgatcttcaggctgaaggctccgagatggttccattcgagcagtatggtctccagaagattgctagacttaactccgtgacgcaggaggctagcaagttccagaacctgctcgtaattcaaccgttttcggtcttggacgctctttcggaatcctctgagggttttctgagacccattgagcgtattggagatacagagtacgccaccatggaaggctacttcaattttccacttgttgtacaatgctatatttccgatcgcgagtcgcatctccatgtgacttatgactcatgtgtgatttcccccaccaacgtcgatgcccttactgagcagttgaatcacgttattcatcaactattaccggagaataataaggctttggaagccaacgaggctacgcttggtgatatctcagtcagcggcccatgggatgttgaacgcgctttggaagctaactctgtgacgccaaccgtaatcgagaagtgcgctcatgaaatcatcgaggagcaagcccaggcgactcctgacgcgcttgccattgtggcctgggatgggaagtttacctacggggagtttgacaaagcagccaacagactggctcatcaccttgttgatgtcatgggtgtgaagaccggcgactttgtccatacatgctttgaacactccatttggcatttcatttcattcctagccatcaacaaggctggcgctgcttgggttcctcttgatccagcccaccccaaggcccgtttagctcagattatctctcagactcgcgccacccttgcgctgacatctgtgacgagcgaggcgatctgcaaccaggtcatcgatcaaacccttgtgatatcgggagacttttataatgagcttaaatctacctatgatgataagctggataagcccaaggtggaagtgacacccagccacccagcttatgttctcttcacatctggaagcacaggtactccgaagggcttcgtgattgaacaccggtcgctctctagcggccaaaccagggcagggaagtggcttggagttacgcccaatgtccgcattctccagtttgcgtcgttggtcttcgatctgtcaattggagaaatttttacagcgctgttccatggtgcttccattgccgtaccttctgaggagactcgtatgaatagcatcaaggacttcattcgagactttaacgtcacatgggcatacctcaccccatcgtttacccggtttctcagcgccgaagagctacccaaccttgagctgctgatgctcgctggtgaggctgtccctcgcgacgtatttgagagttgggttggcaagctccgcttaataaatgcttggggccctgcggaggcctgctgctttgcatctttccatgaatggacgtcatcagatgagtcgcctttgacgattggccgacctgttggtacatattgctggattgttgatcctaacgatcctcagcgtcttgcaccatttggaactgctggcgaagtcgtgatccaaagtcctcagctcttgagggaatatctatcagaccctgtcaaaacaaatgctgccacagtggctgagctgccccagtggacgccgatgagggatcagccctacctcaaccggttcttcaagacgggcgatctttgctcttataaccctgatggcacactggaatttatctcgcgaaaagatactcagatcaagattcgtggtctccgagtggagctgggagaggttgagcatcatgtgcaggagaagctttcagtggctcggcagtcggctgtggatgttttcaaaggagagaagggttccagcctggttgcatatttctctctcactgatgacactagtccggcaactgatgatgaggacatcttcctacctctcacgcaggaattgcaaggacatatcgtctccttaatcagccaactaagcattgaattgcccggttacatgattccagatcttttcattcactgcagcaagttgccgtcaaacatctctaccaaattggataggaaggcactgaagaagagaactgctgccttaacgagggaccagttggctcactatgcccttgtcgatagcaacaaacgacctcccgagacagaggttgaatccagtctgcagttgatctgggcagagctactgaatctggaccgggaggcaattggtcgcgacgatagcttcctccgcattggcggtgactcgatcatggcagtgtaccttgtcgctgcagcgcgcgatattggcctacatcttacggtgaagactatattcagcgatcctcgactctcgagcgtggctgccaactgtgaggtaatggacccatccagcatgcctgactggagtgatgtgaagccattctcacttattgagcctgctagccgtgaagaagttgttgcttctgtcaggacacagagtgatttgtctccagagcaagaagttgcagatgtctacccctgtacacccttacaacaaggtctgatggctttgtccgcaaagcagcccgggtcatatattgcgaaatgggttcaccggctgtctgacgatgttgatgctgcatctttcaaaactgcctgggagaagacggttgagcaatgtcccaacctgcgtacgcgtatgataaatactctggataccaccctccaagcgattgtgactaaggatgtttcatgggagtccacatctgggatggatcttggcgatttcatgaagtttgctgggcaaatgaagatgacctttggatctagacttcacagatacgccttggtagaggaagacaatggcgatcgctattttgtctgggttgcgcaccacgctatctacgatggatggaccatgcgcttgatcttcagcatgctcgccgacaattatatgggcatagattcactgaagatcaatccatactcatccttcatcaagtacactgaaagtctagatatcgattcagccaaaaagttctgggcctctcaattggatggggcgaaacatgcaccctacccgcaggttcctgtctcgaggagctctgactctgagcgaaccttccgactcttgcgaaagaatatggaatttccgtcgcttacggacacttcgattacgaaagccactatccttcgagccgcttgggctgtggtcctgggacgttactgcgatactggagatatttgctttggaacgactgtgtctggtcgccacgcccctgtgcccggcgtgggtgaaatgcccggtccgatgatttctacacttcctgtgcatatcgtcatggacagcgagaaatctgtatcctcattcctttacgatattcagaatcaggcggccgagatggttgcgtacgagcagttcggtttgcaaaacattggcaaactggatatttccattcaagaagcttgtaatttctctagtcttctcgttattcagcctttcgaacaaatgggtgccattggaaccaactcggatgcgattcttcagttggatgcttccgcaaaacatggaactgaggacactctgcaaggctactttagttatccgctggttgttcagtgcgagccatacgaagatcagttggatcttatcttgacgttcgattctaacattgtaaagcaagcagacatggagcgcctctcgaatcatttccaacatgtggtaaagcagttactagcccaggatagccgaaagctgggtgatatttcagtctcatcgccctgggaccttgaccaggctgttaagttcaacggagaggttcccccagtggaagaaaatacacttcacgagatgattgaacatcaggtccgaattagaccagatgagcctgctatcgtagcctgggatcggcaattgacatattcagagcttgatgttctagcgaacaaactggctcgaatgcttagagacacctacaaggtgcaagccggagacttcgtaccagtctgctttgaaaagtctgtctggcactttgtttctattcttgcaataatgaagtgcggtgcagcttgggtgcctcttgatcctggctatcctctagagcgtatgaggaacattgtgcatcaaacgaaagcaaagattattctagcttcgccttctaacctggcaacttgtactgagcttgttgaagagattctcgaagtatcggataacctggagacgactttccaagagcttgggctctctggcgaagcactgaatgtcgaagttctcactgaccacgccgcatatgtactcttcacatcaggaagtacaggcgtgccaaaaggactcgtaatgcagcatgcagcggtatgcagtgcccaacgagcgattgcagagagacttggactcgaaccagccgtaaggatgcttcaatttgcttcattcgtttttgacctgtcgattggtgaaatttttgcccccctgataaaaggagcttctatttgtattccctcagagcacgaccggctcaatgacttggctggcttcatctctaagacaggagtaacctggagcttccttacaccctctttcgctagaaccctcaagccagagatggtgccatcccttgaacttcttttatttgcaggagaagctgttccgcgagacgtttttgaagtgtgggtagggaaagtcaggctctggaatggatggggaccagctgagacgtgctgtttcagtacgcttcatgagtggtattctgataaagaatctcctctcacaataggccgcccggttgggtctttctgctggatagttgatcccgagaacccacacaggttagctcctctgggcactgtaggcgaagtggtaatacaaggccctacactgttacgggagtatctcgcagataaggccaagactgatgcgactactgttcgttcgctacctacctgggctccttcctccaatgttcctcgcttcgacaggttcttcaagtctggggatttgtgcttctataacgacgacggtactattgagtttttaactcgaaaagacacacaagtcaaaattagggggcttagggttgagctgagcgaagttgagcaccagatcaagtctcacctttcagatgccgcccaggttgcggttgatgtttttcagggagcagcgggcgcgaaccttgtggcttatatctgctatacaagtgcaactcgcacggctgagctttctagtgaagacatgttcgtccctatccagtccagcatccaacagcagatttccatcatgctcagtaagcttgctgttactcttccacgatatatggttccgacaatggctataacctgtgactatatgccgtttgtgacatcttcaaaacttgacaggaagaggcttcgagaagaaactgccaagcttaacatcgagcagttgaattactactcactacttgatgcagagaagcgggaaccccagacacctactgaaatcaggctccaagagctgtgggcaaagaccttgaagatcccggctggatcaatcggtcgggatgatagcttccttcgtattggtggtgactcaatttcggccatcctgttcgtcggcgctgcacgagagaatggaatgatgattcaggtcaaggatatttttgatgatccgaggctgtgcgctgtggcagagaaggttgttgaaatccaggcgacagataactctccgccgcctgcaccttttagcctacttggtatttcgaaggaattgcttgatgaatctattctcaaaattaacgagcttcctacctctgcgagtatttccgacgcttacccttgcactgctctgcaggcgggcttgatggcactctcgctcacgcagccaatgtcctacgtcgctcgatacgtacaccgcattccagattcagtgaacatatccaggcttcgagaggcttgggaggagacagttggactttgccataatctgagaactcgtatcgttcttgtctcaggaatgagtattcaggtcgtggttgaaaacgattcgttttgggagtcggagaacacaaccagccttgactcgttcatggctcagagcaaacaaacgactatgacatacggctctaagctctgccgcgcagcgatcatccagcaagcgaatggagagaattatcttgcctgggctgttcatcactcagtatcagatggtttcactctcagaatggtgatggaaaccttttattccttgtatagcaagaccccaggacctcagttgagaccttactcgtccttcatccagcatgtttccagcattgatcatgaggtcgctgttaactactggaaggaccaacttgaaggtgtgaggccgccctctttccctaccaagcagaagctttcaggaagtaaggcgaccagagtcctctataaggatgtcaatttcacgcgatccgacttgtctgtgacacaggctacgcttattcgtgccgcatgggccatcgtgctcagtagatacagtgatacacctgatatttgctttggagcaactctttcagggcgccaggcaccggtagatggtattaccaacatgcctggcctcgcaattgcgacggttcctgtccgtgttcaggtcgacaccgatggacagatcaatagcttccttcaaaccgttcaaaagcaggccgctgatatgacttcttatgagcaatttggactgcaaaatatcgcaaagttagggagagatgcccaggaggcttgcgatttcacaagtctcctagtcgtccagccctatgagcaggtgtttggtagcatgagaaacgacttcgtttttggacccgataatgaggtctatagcactgaggacgacatggaaggatatttcaactatcctctcgtaacgattgcaaacatcatgcctgataagatcaaattgcagttagtatatgatgcagaagtcatcagtccaggacagatggacgctctctcacagcactttgatcatgtaacccagcagcttcttcagccaggaactaagagtcttggctctgtctccgtctcaggaccgtgggatctccaaagagcgaaggagtggaatccaaaccaaccacgatcaattcgagcttgcattcatcaccttatttcccaacgtgcttcacaggatcctacacaagaagccatctactcctcagaaggcagtctcacatttggagagcttgagagcctttccaatacttttgctcgctatctcgtctcacacggagtagagctggagactattgttgcattctgctttgaaaaatcgatttggactattatcgcaatgcttggtatcctgaaagccggtggtacatttgtggctcttgaccctgctcagccagaacagcgcaggagaactatcattcaggagacaggctctcagtacattgtgacctcacctaaactagctcgtatttgctcaggcatggtgccgaatgttatcgagctttcgctttctttcctcgaaagactccctagagtcactgactcaacaaagaagattgcattgccccagtcttcccctgaccgcaccgcatacatcatcttcacgtctggttcaacaggaacacccaagggcatcatcgtgaaacactcatccgtgtgcacttatgtattaggtgctgatcgcatatacgcgttagacaacagcacgcgcatgctgcagttctccaattacgtgtttgatgtaagcatgggagaaatcctcgagactttggcgatgggcggaacaatctgcactccatcggaacaagagcgtatggagtctctccctcggttcatggaaaacgccaaggtaaacacagctatgcttacgccatcctatatcaagacaatggaacccgcagacgtgccttctctcaagctcctagtcactaccggagagccatcaacgagggatattgtgaagaaatggcagcctcatgtgagacttatcaattcgtatggtcccgcagaggtaaccatcaatgttggtgcttatgagtaccagtcgtctgaggaccaagtcactaatataggccgcgcttggggtggtcacatgtgggttgttgaaccagacaatcataacataattgctccaatcggttgtatcggtgagattctgattcaacgagatatttcacaaggctatctcaacaatgcggagaagacgagtcaaaactacatcaacgctgttgacttcttatcagtggaggacccatccgttaagttctataagtctggggacttggggcgatacaatatggatggaacagttgagatcattggccgtcgcgatacacaggctaagcttcgtggtcagcgtttggaacttggagagattgagtatcatatcaggcaacagtatgatgacattgaacttgttgccgctgacgtgatgcctgtccgatctcgtgcaaccctggttgcgttcgtaagttttaagcctgggttcgattcgttccagccatcagaacttcctctgccgttcatgcagccaagcgaaagcttgatgcatagattgaacgcacttgttgagagtttgcgggctattctcccaggatacatggttccttcttttttcataacccttgattcgatgcccctgaacacatcgtcgaaactagatcgcaagcgggtgaaaatgctcgcattggccttgaatcaggaacaaatggacctgtacactctcgacaatgccgaaaagatccaagcaaccacgagcagagaattgcggttgcgggctttatggtcccagattttggaactagacgaagagagtattggaaagaaggacaacttcttccaaaatggaggcagctccatcctggctattcagttgatgtctcttgctcaaaagcatggcatctcattgtctgttgcaagtgttttcgcacacccaagtcttgaagaaatggcattaagtatgaaggaggaagcctcggaggctgctacaattcaaccattcagcatgctgccactagccgaggggattgtgaagagtgaagtccaaagccaaagtgagatatcttcacttgaggaatttgaagacatgatgccaaccacctcgctacaagaagggctaatggcactcaacctcaaacaattctcttcttacactgcgtatattcctttccggattgccgaatcagtcaacatcgacagactcaaagctgcctgggaacaaactgtgcagacctgtactaacctacggacaaggatctttcatgttcaaggacacactcttcaagccattgtcaaggagcaggctatctgggaagaatgtgaagattcctcactacgagggtttaagcaacatgttgaatctaggcctatgggctacggatcaagactttgcagatacgctattgtcaatgacagcgggaattcttatttcaccctggcaatccatcatgctgtgtacgatgggtggagcttaggtttagttctacggaccgttctgagccgttatattggaactgaggccccgacgattcagccatactctggcttcatctcgtacatcagccagctggatgaggatagcatgcataattactggacaaaatatctccagggttcggtgcaagcttcattccccgtcaaaatagccagcggaccgagcgagtctcgcacctgtgtcaaaccaatcacgttccccgaatccacggacaatacaatcacaaaagccacgatcgtacgagctgcatgggccatattactcagcaagtactgtgaaactgacgatgttacgttcggaatgacactttcagggcgtcaggccacagttcctggtgtaatagaaatggctggtttgaccatcaccacagtccctgtccgggtccagattgagaagagaaggcgtgtctcccaattcctacacgatatccagactgaagcttcggctatgattccgtacgaacaatatggattgcaaaaaatttcaaagactagcccagaagctcagcaggcttgcgttttcagaagtctgcttgttgttcagcccttctcagcgcttgatgcgatggatgaaacgtcagaaaagatcctagagcaatcaagcgaccccgatcttgaggactttttcaactaccctcttgtggttcaatgcgagatgtctgattctaaggccgagttgcacattacgcatgattcacaagttattgatagtggtcggattgatgccctctctgtccatttccaaaatgtcattaaccagttattgccagagagtcaacaagaaattgaagacgtagagcttacttcttattgggactttgagaaagctttggaatggaatgggaagccggcaaagacggcacacacgtgctggcacgaagtcgtccgggctaatgccaaagcctatcctcacgatgttgctatcaatgcatgggatggcactctgacgtaccaacagttggatcagacaaccgataggcttgcatatcatctgattcactcgcatcatatccaacaaggagacatggtggttgtctgttacgagaagtcactttggtatactgtctgcattttggctgttagtaaagctggagctgcttgggtcccaattgatccgtctcatcctagacaacgtcacgagtctataatcagccaaatagatgctaggattgctcttgcttcatcgatgcacttggaatactgccaaaagattatcgggaccgtgctggaggtgacgcccgagcttgatatccagctgcagcagaacctcgcttcagaagatgtttcggtccctcaggtatctccaaagagtatcgcttatgtgctatttacttctggaagtaccggtactccaaaaggatttgcaattgaacattgctcccttgcgactagccagctgactctttgggagaaactgtctatgccgcacgacgcccgagtcttacaatttgcatcacacgtgtttgattttgcgatctgcgaaataatcggctccttgatggaaggagtcactatatttgttccatcagaacaagaccgaatgagcaacctggtcgattttattaacacaactggaattgactcgttgttcttaacgccgtcgttcgttcgtactctgcccataccagagcttcctcgcgtcaaccttttgttcctcgcaggagagactgttacaaaggatattttggacacatggtttgagcaagcccgtattttcaacgcatggggcccagcagaaacagtcgtttgtaataccgtccatcaatatcgctcagttcacgactcgccagccaacattggcaagccaactggcggattttgttggcttgtagacccccagaacccgcataagctagcaccaattggaaccgttggtgaagtggtaattcaaggtccaacaatcatgcgccattacgttggcgatgaggtcaaaacaaacaacacagttatgccgacgcctgaatgggcaccgttccatgatgttcctggatgggaccgggttttcaagacgggagacctttgctattataactcggacggaaccatggacttcctgtctcgaaaggatactcaggtgaagatccggggtctccgagtcgaacttagcgagatcgagtatcacatccggcattctcttcctgatgttgttcaggtggctgttgacgtaattacttccgccaatgcttcgcagctagtggcttacatatgtttcacggatgagacacgtctggagtacaatttgaatgacgtgttcttctcactatcatcggatctcaatgaccagatggttgagctactcggaaagcttggctcgctcctccccacctatatgctgccatcaatctttattccttgcaactttatgccttctataacatctaccaagctagacagaaagacattgaaggatctaaccgcatctctcagtcagtcacagctttcgcactattccctcgtcagtgcaacaaagcggaagccggacaccccaatggaacgccgccttcaacacatctgggccagtatactaggtcttcctgaggataccattggtaaggatgacagctttattcgtattggtggagattctgtgaccgcaatttatctatccagcgcggcgagaaaatctggaatcaacctccaggtgaaggacatctttgacgatccccgcttctgtgcggttgctgaaaaggctgtcatggttgagtcaataacggaaataagtaacaatattaagccctttgaattgttggactttgatatttcatcacaccaggacaaaattcgacaaacctgtgacctgagggacgatcagatcatcgagaatgctatgcctgtcactccactccaagagggtttcatcgcgttgtcagtgaaacagcctggatcttatattgggagatggatctatcgccttggagacaacgtaaacattcatcgtttcaaagaggcctgggaagcaacgattcgacgctgcaacaatacccggagtagaatggttgctgtcgctggtcgcacggtgcaggtctacatcaaagatgatatccaatgggaggatacctcgaggttgaatttgaatgaattccttgagaaatctcgaagtattgagatgactgttgggagccgattgaaccggtatgccctcatccaagaatcatcaggtgacaacttctttgtcttccttgcccatcattccatttacgatgggtggacaatgcgtattattctcgacaccgtgtctaaagagtatgagtttatttctacaactatacaaccctttgaccatttcatcaagtatgtcagtgctatcgaccaaaaggctgctgaggagtactggcgcacgcagctccaaggtgccaagcgcgctggattcccacgcaccgcaaaggccgtcgggcttagcaaggtgatgaacagagtcgtcgacttgaaagacacgagcatctccgtgacgaaagcaacgttagttcgagcggcatgggcactggttttggctagatatgctgatacggaggatatatgctttggaacctccatttccggccgccaagccgctgtccctgggattggcgatatggctggtccagcagttgcgacagttcctatccgtattcgtttggacaaggaaactcccgttgctgagtttttaaataagatccaagtccaggcgactgacatgataccatttgagcaaactggcattcagaatattgcaaagttaagcgatgatattaaagaggcttgcgacttttcaagccttcttgtcattcagcccgttgaagctatgggacaagttggaaaggattctgagaaacttttgagcacggtgaatgatgattacgaggacataagtcaatcgatgaatggctattacactatgcctcttgtcatgcaagctctactgtcagaaaccgagctgtgtcttgatgtcacttatgacgtcgcagtaatttctgaagctcaagctacagccctcgtcaatcagatggagcatgtcatgaatgcaattctcataaatcaggaggagccacttgcaaatctggccgttgccggggaatgggacctcgcccaggctatgagattcaatagcaacatgcccgaggtcatagagtccactttccacgaaacagtacagggacattcagcaagcaatccagagtctattgctgtcgatgcttgggatggattatttacgtacagggaattgaatgacagagccaaccgcctggcgagttatctcgtcgtacgaaaccttgtgaagccgagagaccttgtccatgtttgttttgataagtcggcttggtatctggtagccatcctggctatcaacaaggccggtgcggcatgggtaccgctcgacccatctcatcctgaacaaaggagaaagcaagttgttttacagacgggtgctacgttgatgctagcctcaccaagcaacgcggaagcggctgaacagctggttgagactgtcatccaggtgtctgccgagctggatagcgagttggccaatcgcaaggatgtactgacatcgggagttgccctcgaagtatcaccatatgatgcttgctatgttctcttcacgtctggatcaactggtacacccaagggttttgtcatcgagcatatgtcgctgtgtactactcagaaagcattttcaacccgccttgggatgacttctgaggccagggtccttgcaaccgcgtcccatgtattcgatatgtctgttggggagacagtttttggtctactggccggggctacagtgtgtgtgccatctgaatcagacaggatgaatgatttagctgccttcgttcgcaatcaccgagtcacctggacttggcaaacgccggcatttgctcgtacgatgagtccagagtcgatgccatgtttggaagtcatggtgttagcaggtgaatctgtcggtcgcgacatctttgagacttggtttagtaaagtccgactgataaacggctgggggccggccgagacttgctgccttagctctctgcatgagtggacatctccaacagagtcactctcagccattggaactcccttggcggagttctgctggattgtggaatctggcaacccgaacaggcttgcaccaattggcactgttggcgagatagtaattcaaggtccgacattgcttcgagagtatctgaacaatcccgaccagtccgcgaagtcaataatcacggatctgccagaatgggtcccaaatagacaacaatggaaccgattctatcttactggcgacctgtgttcatataatgaccaaggatctctggagtttgttagccgtaaggacaaccaagtcaagatccggggcatgcgtattgagctaggggaagtggaacaccaaattcaatctctgctgccacccgaatgccaaattgcggtagatatgttcaaaggcacttctgggtctaccctggtggcatatatttgtttcactcaggcagcaacatatgctggttctagtgatgactggagtgatttgttttcccagacagattcttccctactacagacggtttctggcattcttcacgagctagaaagggcacttcctgggtatatgatcccatcaatgtttgtgccgtgccagtacatgcccttcatcacatcaactaaactcgcgagacgggttctgctcgaagagacgtcaaatctttccccagagcggttgcatcagtactctctctccaatattgacaagcacgcaccagaaacggctactgaaatccaactgcagtcaatctgggcacaagtgttgagcattccggccgacagcattggccgcgacgatagctttttgcgaattggtggggattcaatcacttgcattatgctttgcaacgctatgcgagagaatggcctctctattaaagttagagatatttttgaggacccccgtcttcacgctgttgcgcgcaaggccaccccagctgaaccctcaatggatctcggccatccagagccgttcagtctcctttctgcaccgcgcggtgatctaaaagcttccgtgcttcgtgaaatgaagctgccagttggtgttgagatttctgatatgtatccttgtacaccacttcaggaaggactactggccttgtcagttacccagccaaaatcgtacattgctcgccatgtgtatagtatacctgcttcggttgacatttctcgcctcaagagagcatgggagcgaactgtggaactctgcataaaccttcgaacgagaattttattgaacagtggcacagcaatccagtgcgtcttcgacaatgagcccatttgggagattaaaactccagacagtcttcatgcattcttggagcagagccgagacattcgaatgacatatggatctcgcctaaatcaattcgctatcattgaagagcctactggctcaaaatactttgttacaattacgcatcattctgtcactgatggctggacactccgactagtgatgagcacgttccatgcaatctacacggagacaaccggattcaacttgcagccatactcgagctttgtcaactacattatgaagcttgatcaaaatgtttctcgtgaatactgggagaggcagctttctggatccaggaaattatctttccctccaacaacaaagagtagccacagtgtccgatcggatgtgttgtatcatgatgttagcttgtgcaaacccgaagatgatgccattactcaggccacagtcgtaagagcagcttgggctattcttctaggacgatacagcgatacaagcgatgtttgcttcggtactactgtttccgggcgccaagcagccctccctggcatcaccgatatgcctggcatcacacttgcaactgttcccgttcgcatccaactcaatgcaaagcttacggttggggatttcctaagagacattcaaaaccaagcttcagaaatgacaagttacgaacaattcggcatccaaaatattgcaggcctcagtcaggatataaaagaagcgatagacttcacaagtctactcgttatccagccaatcgaccagatgttcaatactaaatcggacaacgaattcgttgaggctattgatgactcgacgtacaatgtcgacaatgacatggatggatactttagctaccccctggttgtaatggccaatctgtattctgaaaacgttcaattacagattgtctatgatgcagacctcctacaccgcgatgcaatcgaaggctttgcgaatcaatttggtcacattgtccaacagctcattgaacatactacaagctccttggagtcaatttcagtggctggtccatgggatatcaaaaaggctaaagggtggaactcgtctgcacccaagcctattcagaaatgcgtgcacaacttgatctccgagaaggctgcggagattcctgaccaggaagccatttttacatctgatggtagcttgtcttacagcgaacttgatatgctatctagtaagctggccctgtatcttatgtcacttggcatcggtccggagacccttgttccgttctgcttcgagaagtccaagttcgccattgtttctatgattggtattatgaaagcaggcggtgtatttgttccacttgatccttcgcatccaagaacccgtcggcaagctgtggttgatgagacaggctgtgaattcattttaagctctccagaatcagcctcagcttgcggatcgatgaaccctaaaatcatcgagatttctgaagccttctttgaaaaaatgcgggatctcacgagtttcaactcggaaaaggctccacgagcaggtcctcagaatgctgcatacgtattgttcacctcgggttccaccgggaagccaaaggccattatagttgagcattccgcgctgtgtggcagccttctaggggaaaacagggtttaccacctcggtagccaatctcgagttctgcaattttccaattatgcttttgacgtcagtctttgtgagattttggaaactcttgtgtttgggggcaccgtatgcataccttcagacaaacagcggctggaatcgctccctcgtttcatggaagaagctagcgtcaatacggccatgttgacctcgtcctatctgaggacattgaacccagccgatgtcccttctttgcgtatgctgatgctggttggtgaagctcccagtcaagatataattaccacctggcagccacgagtcagactgattaatgcatatggcccatcagaagtctccatcttcattgggtcccatgagtataaatctatcaatgatcaggctacgaatgttggcacagccttcggaggaaatatgtggattgttgagccagatgatttcaacaaactttcaccgataggatgtgttggtgaaattctcatacaaagagatatggcccgtgggtatctcaacgatgagcagagaaccaatgcagcattcatcaagcaggtcggattcatgggtggtaccgaatccccgatcaaatttcacaaatctggggatcttgcgcgatacaatccggatggtactattcaataccttggtcgccgggacactcagactaagcttcgtggttatcgaatcgaattgggagaagtggaatataacatccaaaagctgcttccaaatgtagaacacgttgcctctgatgttgtttcagtcggctcacgagagacgcttgttgcgttcttgagctttaagaacacatcagatgaaacagattttgaaggcgacggttctatgacggacctatttttggcacattcagatgagatgaagcggaaactacagaagcttcttgatgatctttacactgttctggcaagttatatggtcccatcggctttcctcccacttcgagagatgcctctcaacaactccttgaagctagaccgaggcagacttcgagctttggcttcaagtctcacgaaagagcaactagccttgttctccgtcgatactggagaaaaggctgagccagtcacagaaatggagataaaattgcgttctctgtggtctgaagtactaggggctgatgttagtactatcggcagatctgacaactttttccaggcgggaggaaactcgcttgttgcaatccagcttatgagcattgcacaggagcagaatatttcgctcactgtagctgatattttcgcgcatccccggttggaggccatggctctggtggtatccggaacacatgttgaggtccaggacgtcgctccactgagcatgctatccatttcgcgtgaagacctcgacttgcaacttctggaacagtccgatatgctagtcgcctcaactcttgaagacgcccttcctacctcgcctcttcagcaaggcctcatggccttgtctgctaaggaagctgaatcatacatcgcatttgccgatttcgaaatctccccctccattgacattgatcggttcaagaaagcatgggaccagacggttcaaatatgcagcagcttacgtaccaggatgcttcacattcaggatcagactattcaagtcatcctcaagcagtcttccacttgggaccttactgatggcatttccatgtcttcattcaaggaatttgtaaatggaaagtctatgacctatgggtctaagctttgctccaccgcgattgtcggagaaaatgaccgccgtttctttgctcttgctattcatcacgcagtctacgatggttggaccatgggattggtgttacgcactcttcactcaatttataagggaagcacgccgcctgttatccagccctatgcacgatttatcaagtatacgcagggaattcaggatgatttaactcgccattactggcaaaattacttgaaggatgcaacctcgggttcgttccctcgcgctggaaagagttcggaggagagcatgacttccaccgtcgtccgtaccatcaagttcccttcttctagcaaaactgccattaccaaagctaccatcatcagggccgcttgggctgttatcctctccaaatactgcgattctagcgatgtcacgtttggtatgaccctatctggacgccaagcccctgtcccaggtttggctgatatgactgggcctgcgattgctactgttcctatccgtgtcaatctcgagaagctaggctcaaccgtggccgagtttcttcaaaatttgcaaaatgaagcttctgaaatgattgctcatgaacagtatggcctgcaaaatatagccaagactgggccagatgcgcaggaggcctgcaacttccaaagtctccttgtgattcagccattctctcctttggaagatatttccaacggtaccgatgccatgttcttgcctgctgcaattcatgaagatacagatgcttccgcgttccaggggttcctaagttatcccctcgtcattaatagccatatatctgatgaggaggcacaccttcagctgatattcgattctgcttcaatccctcaaatcaggatcgaagcactttgcgagcactttaatcacgtcattcagcaacttattatcaatacagataagtctctacaagaccttgaagtttcctcagcctgggatctcaagcaggcaatttcatggaacggcaaagctcccgactcgatcaacggatgttggcatgaagttgtggaagtcaacgctatccgtcagccccattccctagccgtaagtgcgtgggatggaaaccttacctacaaaggtctcaatgacgctgccgatcggcttgctcgccacctggtccgcgttaggaacgtaaaggaaggggacaatatcttggtctgctttgaaaagtctttgtggcatacggtttgcatattggctattagcaaggcgggagctacttatgtgcccctcgagccttcatatccaacggagcgcaaagaatatattttgaaacagacgaagagcaagctcgcactagcttcaccagccaattctcaagactgctgggacctggttggcaatgtcttggaggtatcaggggctttagaaacacaacttatgaaacagggctcgcctaagtatcttcgcaaggtctcgcctgaaacagctgcgtacatcatttttacctctggaagtacaggaacgcccaagggggttgtcattgagcagcgatctttggtgactggtcaagctacaatgttcaacaatcttaggttgcaagaagacgtaagaatgcttcaattcgcttcatatgcgttcgactattccatctgcgaaattattggcacattaatgtacggcggctctatccacgtgccgtctgaagacactaggatgaataaccttgcacacttcatcaacgagaataacgtcaatactatcggcatcacccctacctttgcacgaaccttgtaccctagagaaattcccaccgtcaagtgcgttatactaggaggcgaggccgtttctcaagacctagttgcaacttggtttgataaagtacgactattgaacgcctggggtcctactgaagcaacaatctgcagtgccttccatgaatatagttccgtcaatgaatcccctctcacaattggtcgccctacgggttgtttctgctggattgttgacccgaataacccccatcgcttggcgccaatcggcactaccggagagattattatccagggatcaactttgctgcgccaatatatcggagatgaagaaagaaccaagcagagtatcgtttatcctgttccggaatgggctccctacagagatatatccggatgggatcgtatgtataagaccggcgatctctgccattacaacgctgatggcacaattgaattcgtttctcgaaaggacaaccaaatcaaaatcagaggtcttcgtgtggagttgggagaaattgaacatcatgttcggcaagctctccatggtgttgctcaagtcgtggttgacattcttgccactgattcgggatcagccattgtatccttcttctcttacaatgaagagatgcgagtcaacgctgactcgaagaatgtcttctctcgcctcacaccgggtcttcatgatcgggtttcagagatgcttggcaggctcaaccttgtccttccggcgtatatggtccccactgtcttcgtcccctgtgacttcatgccagcgattacatctggcaagcttgatagaaaaatgctacaaaaccttacaggaactctaagcaaggaggaattagcaaattactcgctggtcaattctatgaaaaggcagcctgaaaccgagatggaatcaagaatgcaagtcatgtgggcagagctcctcaacctgcccctggaatcaattgggagagatgatagcttcctacgcatcggcggtgactcggtgatggcaattaccttggtcagtgcctccagggcatctggcattttattctcggtcaaagacatatttgatgaccctcgccttttcgctgttgctgctcgggctattgaacaagagcctggagatgatgatattactgagatcaagcctttcgaattgctggatgccaatactcgctccgaggtcgttggctcatctgttcgcgaggtttgcggtctacaggacggccttcgcatagaaaatgcaatgccagtaaccccacttcaagaaggattcattgccttggccatgaagcagccagggagctacattgctcagtgggtttatgagcttgcagaaaatgttgacgttgatcgcttcgcggcagcctgggaagagaccgccagggtttgttccaatcttcgaacaagaattgtacgaattggaaattccacgactcaaatctcggttgaggacgatatttcttgggaggataccaccggcctgaccttggctaagaccctggacaggacgggctccatagaaatgactctcggttcacgattgagtcgctatgcattggtcaatgaacctggatccagcaagacatattttgtattccttgttcatcacgccgtatacgacgggtggacaatgcgtattatcatgagcaatttgactagtgtctacaatggctacccagcattggacctcatgccctttgaccacttcattaggtatgtgcaagatctcgatcgggactctgcgaggaggtactggcaggagcagcttcaagatgcaaaacgagctgcgttccctcgtatctcgaaaaatcagaacgccggtacaaccaagcttgttacaagggatctacaactccctactactgatacatctatcactaaggcaacactcatccgagcagcatgggcgatcgttttagcaaggtattcagaaaccaaggatatttgctttggaacgtctctctcaggaagacaagctcccgtaccaggactgggcgaaatggcaggcccagcagttgccaccgtacccgtacgcatcaaacttgatgagaatcctcttgtttccgagttccttaacaaggtgcaagcacaagcatccgacatgattccctatgagcaatttgggctacaaaacatcgccaagatttctccagacattcaagaggcatgtgacttttcgagtcttctagtggtacagccatttgagaggatggatcagctcgcagaagctgcagattctatcttgcaattgactgaaatggaagaagacttcgcagagagaaatcttgaaggctatttcaatatgccgttagttctccaagtccttgtctctgaggaggaacttagcatgagtatgtcttacgacgtgcaagtttcagacgagaatcaggtctccgccatgttgcatcacatggagcatgtgatcgctgagctccttggagaagacaaaaagctgcatgacgtatctatcacaggagaatgggacttggagcaagctctcacggtcaacagcgatgtccctgagatttttgatgctacattccatgagatgctggataagcaagctattctccgccccgattcagttgctgtccattcttgggatgggtctttcacctacaaagagttggtgactcacgccaataaatgggctcgacatctcgtcgaatcagcactcgttcgacctaatgatctcgtgcatgtctgctttgaaaagtcaatatggtacttcgtagctatcttggcagtcaacaaggctggcgctgcctgggtgccacttgatccgtcgcaccctcgacaacggcatcaacaaatcatcaagcaaacgggctctcaagttgttctcacgtcacctccaaactcgagcctgttcttgaatgtcattcagaatattgtcgacatttcagctgagcttgacggccaattgaaggatggccgtccagtagatatccatgtgtcccctcaggatccagtatacgtcctctttacttccggctcaactggtacgccaaagggtctgatcatggaacatagctctgccatcacgagcatcatgtcgtttgcgaagaggctcaacatcgaacactccgttaggagtctccagtttgccccctttgtggtggatttctcgataggcgaaatcttcttctctctgctgaatggaatgagtctttttgttccctctgacgctgaaaggcttaatgatttaccagggtttatcagacagcacagcatcgcttgggcattcctaaccccgtcgtttgcccgtactatcaagcctggggaggtacctaccctggagctcttgctcttggccggcgaacaggtcacccaagacctcttcgatacttgggttagtagagtaaggttcctcaatgtctgggggcctggagaagactgcttccttagttcgttgcacgaatgggggtcggaccaagaatcggtgtatacggttggtaagccagctggttctttcagttggattgtcgaaccaaatgaccattcaaagttggctccatttggcacggttggagaagttattattcaaggaccgacactgatgagagaatatttggcggactcagatagaacggcggaggccatggcaatcaaccctccttcttgggcgttccgctcttcagacaagcgatggagtcgcttttatcggacgggtgacctttgctattacagacacgatggcaccctcgcattctttgcaagaaaggatacccaagtcaagattcgaggtcttcgcgtcgaagtcagcgaagtggaacatcagattcgatcaatcatcccccagggttgcgaggcagtagtgggaacaatacgtggaaccgggggtgtaaacctcgtggcatacatctgcttagacccaggggcgtcgtcccaaggtacctcaagtgcccacgataatctctttttggctatggattccgatgtgcaaactcaaatgattgaactgaagaagaaagttggggctgcacttccgccttacatggttccaacgctgtacattccttgcaagacaataccatctgttagcggcaaggttgaccgaaagaggcttcatgaggagacgcagagattagatcaagcccaaatttccgagtacgggcttcaaaatgtcgagaagcgcaagcctgcaacggagctcgagattaacctccaaaagatttgggcggatgtgcttagcattgaccccgaatcaattggatgtgatgatagcttccttgcaattggcggtgattcaatctcggcaattaatcttatgactgctgcacgcgaagaaaacatcttcatcaccgttgatgagatcttccgccactctgatctgtctagcatggccctgcacgttggaaagtcaattatctcacaagctcccgtgaccgaggtgaagccttttgagttgcttgtcgacgatgaaagggaactcatcaagagcgaccgactgcgcaagctctatgatattccagagaattgcaacatcgaggatgcgttcccttgctcgcctttacaggaaggccttatcgcactggctgtaaaacatccaggctcatacatttccaaatacgtattcaagctccccagccacgtaaatattgaccggttcaaagcgtcttgggagaaggcagtccaaatgaactgtaacctgcgaactcggattatccctgccgaccaacgctctcttcagatctacattactggtgatcaggagtgggaggacacagcaggcttagatctggacgcatacataaaagctactcgaacttgggagatggcgtatgggtctaagctgagtcgctatgcagttgtgaagagcaactctggagatagccatttcgtctggattgcgcatcattcgatcattgacggctggtctttacaaataacgttcagaactcttcacgagtactattggaacagccctgtcaccttgcttccatcgtatccagggtttattaagaacataatggagcttgacaacgacgaggcgagctcattctgggcgcgaaaattagaaggtgcctcgcgtccttcctttccctcaccgcatctagataccaagcccaacttcgagtttgtttaccaggatataagcatacctgaaaccttctccggctccatcacgagggccaccgttctgcgagcggcgtgggcaatcgtccaggcaaaacattgtaactctgatgacatttgctttggggctactctatccggccgcaatgcctcacttgttggcctgcagaatatgcctggcccagctatcacaacaatccctgttcgtattaaacttcaagatcgaggtcaatccattcaggagcttcttcaacaagtgcaagatgaggcaatcgagatgtcagcttttgagcaatttggtgtgcagaatattgctaaggttagcgattatgcaagggatgcgtgccgattctcaaccctcatggttattcgtccaaagcagtatctgcaagaatctgggaatgacatcctgataacgactgatgaggagatgaacattactgagaaggagatggtgaattacttcaattatcctctcatcatcgaatctggcatgcttgataataaaataagcatccgattcgttcatgacacgaatagcttgacgaggaatctagtagaagcgattgcgcatcagctcaatgaaatcgctacacagttctttagtaacatctcaaagactgttggagatttggtgttttccgggtcttgggaccgggaacacgcacttagacaccaaaacttgatgccttccactgacatgtgttctcacgccatgatactcaaacagattagggagacaccagatcttcctgccattacgtcttgggatggtacaatgacttacagggaggttggagattatgcttcgagactcgctgcggagctccagtctcttggcgttgggcctgagcaacttgtgcctatttgcttccctaaatccatttgggccgcaatttccatgatcgcgatcaatttggccggtgccgcgtttgttccattagaccctactgcgccggtgaacagactcaagacgatcatcgaggatgtccaggccacccttgtcctctcatcagaagactctcatcatatcgctgagcagttaggtactaaactactacccgtgaacgaaggatttgtcaagggtctaccggctgtctctgcgacagagctcaaagatgccgccaagccatcgaacgctagcttcgcaatcttcacctctggatcaactgggaaacctaagggtatcctgcatgaccatgcctccctctgctcagccatcgtgggctataccgacaagatgagtttcggacctggaaccagagtatttgcttattctgcatacacgtttgattggggcataatggatgtttttggtcccctttcccgaggtgcctgtgtttgcattccatctgactaccagcggtacaatggcatcgccgaagcaatcaacgagcttcaagccaactgggctttctttactcccacagttgctggcctgattgatcctgtgagcgtgccaaatctcaagaatattggtctaggaggcgaagctatctcgcagcagctagtcgaccactggagagactctgtctctcttcacaatttctatgggccagctgaagccactatcaatggttatcagacagtaggcaagtcagataaccccaacaatatcggcggcccaatttcatccgcatggtgggttgtcgaacctgagaatttgaagaagactgttcctgtcggctgcattggtgagctgctcatacaaggccccctgctggctcgcggctacatcaatggcgggaatcaggccgatgctgcctggttagataacgtcgactggctgccaggcaatatgcccagcagagcatacagaactggagaccttgtgcgccgcaatgcagatggtagctttgattttatggggcgaaaagatacgcaaatcaagctccatggccagcgtgtagagcttaccgagattgagtatcgcctagatgaaatcttgcctcaagatatgacttgcgtcattgacacgattctgaatgacgagaccaactcaaatactttagttgctctcatttggtattctacggggcctatttcaactcatcctcagttcgaaatagtggaagaagtcaccgaagagatgagaagccttattgcttctatcgactcttctctaaatcacgtactatcgagttatatggtccctagcatgtatctgattttccaaggtttacctgagcgccttagttctggcaagattgctcgtcgtaaactccggtcgattgcacacgatacgcatgcaaaagatcgtttgaaattttcaccttccaagacaacaggcgagccaccagtcgcggagagagaactgagactccgcgagttgtgggcacaagtcctccgaatcgatgctgaggagatcaaacgacatgatagctttttgagagcaggtggtgactccattagtgctattaggttagttaccttagcacatgagagagggcttgttcttgatgttgcgaccgtcttccgagatcctagactttctgctatggcagccgcgatagaatcaagcatccatgctctcgaatataatgttgagccgtttggccttgccgaccaggacaagatcgccaacatgaccgttgaagctcgaaggcaatgcaatctttctggtggaacagtcattgacgacattttcccagccactcatttacagcagggactcatggctctcaccgttaagcagcctgggtcatacattgcaaggcatgcatataaactatcagaacatgtcgacatcccgaggtttcaagaagcactccgaaggaccgttgaagcatgccccaacttgcgtactcggataatcgattttgaaggtcgggcactgcaaatcgttgttcgagatgattatgactgcgaaatggtacctggacacgcggatctgaactctttgatggaatcttcgaataagatcaacatgacatacgggtctcggctgaaccgattcactcttacaagaggtaacagtggcgtttacttcttatggcttagccatcacacaaccttcgatggctggagtattgggatcgtcatgtcaaccttgaacaaattctaccatcgcatggatgttccagaggtaaagccatattcctcgttcgtctcatacaccttgacagtcgataatgctgccgccgaaacgtattgggctagtcagttgagcggctcccaaaaggcgtcgtttccctcacgacagctgactccttcgggcgcgacgcaagtgttcgcaaaggaacttacattgcctcagtctgccagaagctcaataactcgtgctacccttcttcgagcggcatgggcaatactccttgcgaagtactgtggaacagagagcgtcactttcggtgccactatttctggccgtaacgctcccgtccaagggatcgagaatatctcaggcgctatgattgcgacggtacccatccatattgtcttaaaccctcagacttccgttgggaaattgctacaggatgtgcagagacagtcgtcggatatgattccatatgaacaatatggtttgcataatattgctaagatcaacgctgatactaaggaaggctgtgacttctcaagtttgatcatgattcagccagctcagaagatgggcctaggaactagcaatgagataatgagccctctcaattcagacgataggcccgtcgaggagtctctccaggggtacttcaactatccgctggtgatgcacgctgcattgatcgatgacaaggttgaaatggcccttatttacgacacaggggtgctgaaacacacacaggtacaggctcttggttatcaattcgagcagcttgtttctgagcttctcgtgaaaagtagcgacatattattgaggcacatctcaatgacatcgccgtgggatattgcaaccagcatttctcgcaaccccgtaccagagataatcgactcttgcatgcaccatgttattgagaactatgccgctactcgtccaaactcaccagctatcttttcttgggacggccagctcagctatagcgagctcaatgatgccgcaaatcgtcttgcatcccaccttgtgaggaagcacaatgtccacgtgggcgatattattcacttatgcttcgaaaaatccatgtggtactttgtagccttgatagctttgatgaaagcaggtgcagtgttttctcccattgatccggagcatcctgaacagcgcaagcagtccattctcagccagacccgggcaaagattatcattgcttctcctcaacatgaggcgatgtgcaaggatcttgtagacaccgtcatttctttatccccaagcctagatgctcaactagatcgcgttccagacaatcttattacggctgtctctccggatgatcgctgctatatcatgtttacgtcaggaagcagcggaactccgaagggttttgttatttcgcatcgagctctgagtactggacagcatgccctcaccaaggtcacaaagttggattcgagtgctcgcgtgcttcagttctccaattatgtgtttgacttctcaatcggtgagagtttccaagctataaacagtggcggatgcatttgcatcccgtcggaagaagtgcgattcaacgacatccaaggatttattcgcaccgcgcgcatcaacagcttgttgataagtccagcctttgctaagactctgaacccgtctgagatcccgtcggtcgacttcctccagcttggaggagacaatgtaccccatgacgtgttcgaaacttggttcggaaaggtccgactcttcaatgcatggggcccgggcgagacctgttacgcttcagctgcatacgaatatagatccatcaaagattcaccggcttcaattggcttgccagcaggggctttcttgtggattgtagaccctgaggatcatacaaagcttgcaccaattggcacgatcggagaagtccttatccacggacctacagtttttgaagagtatcttggtgaccctgagaggacgaaagcatccgtggtaacagatcttgctccttgggcgcaacagagggatgtacccttcaccagagcattcaagtcaggtgatctcgcgttttataatgccaatggcgtggtggaatttgtcggccgaaaggacacacaggtgaagattcgtggtctcagagttgagctgggagaaatcgaacaccaagtttcatctatcttgggtggagcttctcaagctgtcgctgaggttcatcaaacagacgaggcttctcgcattgttctttacttttcattctccgatgagagacgaagtgtagatgaaatatcttctacagacgcaatgttctctcatatcacgcccgaggttgaacccaagctccaagagctgatcggaaagttgaaaatggttcttccaggatacatggttccatcaatctttgttccatgcaactttatgccaataggccgatcatcaaagttggaccgtggcttattgaaacgttttgtggcagagcttgacacggataggctccaacactattcccttgcaaacagcgtgaagagatcgccggagacccctatggaatttcgtctaaggtcaatctgggcatcaattctgaacctgcctgaagactctattggaagggatgataacttcgttcacatcggtggcgactcaatctctgctatccaacttgtcactgcagcccctgggcttggaatcaagttaaccgtgcagaatgtctttgatgaccctcggctgtatatggtggcttcccattgcgttgagattgagatccctactgaatcttatgaagacctcgaaccatttgagttggtccccgattcactccaggaaatggactgggaaagtgaggcaattgagttgtgtgatctcgacgatgaacagacaattgaaaatgccatgcctgtcacgcctttccaagagggtttgatggctcttctgatgaagcaacctggttcatatattgcaaaatgggtgtaccgtattcctgccaatgtcgacatccgtcgattccgcaacgcttgggccaaggttgtcttattttgccggaacttgcgaactcgtatcatcaatattggccaagttccattacaagtagtgattgggaacgatacagcctgggagaatactaagaatatggacttacagaagttcttggatctacacaagaatatcacgatggctcccggtactagattgaataggtgggcactcataaaagaacccactggcgacaattacttcgttctaatcacccatcacgctacttacgacggttggacaatgagacttatgctacggactttggccgaagcttacaagcgatccaagggaccttggcccaagccatttgacgggttcattaaatacacaacgaaaatgaacaatgatcgcgctcgggagtactggctcgatcaactgcgggatgccaaggccgcccctttcccacctgtcacacgcaatgctgagacgaagactgaagtcatgaacaagcttgtggagctacccagatccgcacacaacgggattacgcaagctacaatcatgcgagcagcttgggctttggtactttcccagtacagcgaaatggacgacatctgcttcggtacttctgtttccggtcgacaggcatctattcctggcattggtgagatagccggccctgtggtcactacgacaccagtccatgtgcggattgacaggagcacctcggtttctgggtttctgcaaagaatccaatcccaggctactgaaatgataaactatgagcagtttggattgcagaacatcttgaagctggcagacaatataaaagaagcttgtacattcagcagcttgcttgtcattcaaccgatggagaagctgcttgaaatgggtagtgattccgacgcaattgttatccccgtcgaaactggaaatggagattcatcaagcctcgagggctacttcagttatcctctggttgttcagactcttgtatcttcagatatgattcgattgaacgtgacgtataactcctgtgagttgagcgagctgcaaattacccgtttggtcaatcagcttgagcatactatcaaggcacttaccattgaggcttcgcggcctttgagcgaaatttccattgccggtgactgggatctaaagcaagcattggaactcaataacgaggtgccaaacatcatggatgtcacgttccacgacttagttgcacagcaagccatgattagaccacaagctgttgccattcgggccagtgatgcaacactcacatacggcgagttagatacctacgccaataatctagcatctcatctgatcaacacactgaacgtcaaaagaggtgatctcgtacatgtatgcttcgagaaatcagcgtggcattttgtttccatcttggcaattaacaagtctggcgctgcgtgggttccgcttgacccatctcacccaactcagcgtcatcaacaggtggtttctcagactggagcaggcttaatactgacatcttctaaatacatgaacactgtttcgggcctagtatccattacgctcgagatcacatcgagtttcctgcacaatttggccctggagatcggcagcagagacgtcccaactaatatcgctagagggtctgatgcatgctacgtcttgttcacatccggtagcacaggaacgccaaagggtcttgtgatgacacatcgatccgtttgcactagccaaaaagcgatcggtgacaggctcggcttgtctccagaagtcaacatgttgcagttcgcagcattcgttttcgacctttccataggcgagattgtgggagctctaatcacaggcgctactgtctgtgtgccatccgatgaaacgagattgaacgatctgagtgcattcattcgcgacacgaatgtaacttgggcgtatcttacaccctcatttgctcggacattaacgcctgaatcagtaccgtcattggaactgatgctattcgcaggagaagcagttggccgtgatgtttttgaaacatgggtcacgacaaaagttcggctcgttaatggttggggacctgcagaaacctgttgttttagtacactacatgaatggaagtcagtcgacgagtcctcactaactctaggaaggcccgtcggaggattctgctggattgtggaccccgaggaccataacagacttgctcccattggaacaatgggagaagtaatgattcaaggacctactatcttgaaggagtacctagccgatccggagagaaccgcggcaactactgtgacaaacctgccatcctgggtcccgaagtccaaggaggagaactggggccgcttttacaagtctggcgatctagggttctataacgcccagggtctgatcgaattttccactcgtaaggacactcaaatcaagatccgcggccttagagttgaattaggtgaagttgagcaccaaatcaaagtcaacttcccagctgctcagcaggttgctgttgatgtgttcaattcaccagctggggccactctcgcggcctacttctgtctgaccaacaacaaccaaatatctggcggatccgacaattggactggagttttcgagtctattccttccagtatgcacgcagatcttacgtctctgacaagcaagctcgacattgttctaccgcggtacatggttccttcgatgttcataccgtgtagtttcatgcctttcattacatcttccaaacttgatagaaaggctttgaaggctctgaccttggaactcaatgccgagagtctacagcattattccctctccgactccgcaaaagcgcttcccgagtcagccatggaaatcaagatccagaccatctgggccgagctactcaagatccccgcggagtcgattggaaaggatgacagcttcctccgtataggcggcgattcgattactgcaatccacttcgtcaatgcagcccgtgaatgcggcatacacatctcagtacagaacatttttgatgaccctcggctatccgctattgctgctcgtgcgacggaggtcgattctcaatccgaagtcacagagttgcagccattcgatctcttggatgaatctttgcggtcatcggtcctaggagatgatattcggaacgcttgcaacctgatcgatgggcaagaaatcgaaaattcattcccagtcactcccctgcaagagggcttgatggcattgtccgttaagcagccgggatcctacatcgcaaagtggatctaccgcttaacggaggatgtcgatcttgataagttccgccgtgctttcgagcatacggttcagacatgcgcaaatctacgaacccgcatagttcgtgtttcggacacaaccgttcaactatatgtcaagaacgacatctcgtgggaagagaccttgggtatgagtcttcttgaatttatgaaagtggctgatgatatgaaaatgcaatttggctcacgcttgaaccgctatgctattgtcagggatgaaagctcggggcacaactattttgtcttgattgctcaccatgcttcctatgacggctggagcatgcaactggtcctaagtgttttgtctgatgcttataacggcaacttcaattcggtcgtaaaacctttcgaccactttatccattacctagcgagcttagacagggaagatggccgtaacttctggttgaatcagcttgaagattgcaaccccactacattccctaccgtttcacaaactcccaaagctcctcttaccaaagttctcaaccaaaagatggaggttcgtgaggtcgatgcgtccattaccaaggctacgattgttcgagctgcatgggcaatcgttttggctagatactgtggcactaacgacatttgcttcgggacttctatttcagggcgccaagctcctgtttctaatctggggcaaatagcaggcccagctgtcgccactctgcccattcggattcgtctggatggctccctatcaattcatgagttcctccgcaaagtccaatctcaggctacagagatgattccatatgaacagtatggtcttcaaaacatctccaaattaaaggacaacttcaaggaactctgtgacttctcgagcttgctagtggtgcaaccctaccagaagatggctgaaatcggtggcgaggccgagactttattaactcctcatgagctggatgagtcagaggctggatctagtctgtcgggatacttcagtattccgctggttttccaaacagtcttatatgatgatatgttcaacctcaacctcacctatgactcccataccgtaacagagttccaagctaaggctcttttgaatcaaatccggcacgtcattaatgatttgctccatgcaacagaaaggcctctctcagacgtgtcactcgctggacagtgggatgaagatatttcccgcgcttcaaatatggaaacccctcacattgtcgagtcaactgtccacaacatgattgaaagacaagcgactatgcggcctcgagctgttgctatacaagctcatgacctaaccttgacatacaaggagctcaacgacagcgcaagtaggctcgctagctactttgtgtctgagaatttgatcaagcctcgagatttcgtccatgtttgctttgagaagtcggcctggcatttcattgctattcttgctatcaataaagcaggtgcggcatgggtccctctcgatccatcacatccaaggcaacgccatgagcagattgttggccaaactagagctacgttggtcctcgcttccgctacaaatatggccatctgcaaggacttggcctatacggttgtggaggtctctcaagcactcgatgatgacatcaagagtaagaacttagccgatctcaaatctttgaagataagcgtgtcaccccgagatgctgcttatgttctatttacctcgggttcgactggcacaccgaaaggtcttgtcatggagcatggtgccgcgtgtacgagtcaagtagcaactgctcaaagactgggtcttgactcaagtgtcagaatgcttcaatttgccgcgtttgtctttgacctttctatcggtgagattctcggaccgcttattagcggcgctacactctgcgtgccatcagatgccgatagaatgaaccgtttgactgattatattggtgaaaataacatcaattgggcatatctgacccctgcattcgtgcgtaccctgaagccagaagatctgcccacattggagctccttgtcttagccggtgaggcagttggacgtgatattttcgaaacgtggatgaataagttacgtttcatcaatgcttggggcccggcagagacgtgttgtttcagtactttacatgagtggcaaagcgatactgagagccctatgacaatcggagcaccagtgggtggcttctgctggcttgttgaccctaatgatcctcaaaaacttgcacctgtgggtacattaggtgaagcagtgatccagggcccgaatctcctccgggagtacctgaatgatcctgagaggacatctgctgctgtcttaaccgagttaccagactgggctccaaacagagaccatgtctcttggaaccgcttttatctcactggcgatctttgtttttataattctgacggcattcttgagttctcttcccgcaaggacacccagatcaaaatcagaggtctacgagtggaggtcgaagaggttgaacatcgcatacgccagcttatgcccagtctgcaccaagttgccgtggacgtttttcatggatctggcggtgctaacctattcgcatatttctgccttgaaaactcaaccagggttggtgggatgtcggatgattgggatgacttgttcgtgccaatgagcgacactcttcaactagagatcgcatcattagcaagccagctacgtactgttctaccttcctacatggttccaacgacatttatcccatgtgcatacatgccctttatcacgtcttcaaagttggatcgtaagacattacgatctaaggcatctgaccttgctcaggaaagtctcgcacaatattctttgcaaaattcaaagaagcgtgagccggagacagaaatggaagtggctcttcaggaaatctgggctgaggttctaaaagtcccttccaattctattggccgtgatgatagttttcttgctattggcggagattcgattgctgctatcaacctcatgaccaccgctagggaacgtggcatctccattaccgctgatgatgtattccgctccccccgattgctagatcttgctgctcgggctgcaaacgctcctgtgcttctaaaatcaccaggtgtagaaattcagccattcgaactacttacagatctagaaagagatctcgtccaacgcggagaaatacataagcaatgtggattacccacaggagcaacaattgaagatgccttcccttgttcaccgcttcaggagggtttgatagctttagctgtcaagcagactggttcctatatcacaaaatatgtgttccaaatctcaaaaaatattgatctctcaaaactgaaagcatcgtgggaacatacaatcaggaccaatggtaatttaaggacaaggattgtcccatcaaaggatcggtcgatccaggtattagtcaaagacgatatcaactgggaaacccatcccggatctgatttgggtgcctttattaaggtcacgcagcaatacgaaatgaccttcggatctcgacttaaccggtattcgatcttaacagatgataaaggagattcgtactttgtttggattgctcatcactccattatggatggatggtcactccaaatcacattcaggacattgtacgaacattactgggaaggggcttctagtcccctcacctcttatgctaggttcatcaaacacacactcgatctcaaaggagacgccgctgctgcattttggtcgaaccagctggaaggggcttctcgttctaccttcccctcatctactgctgacagctcactcaagccaacgttcaagttcaaacatcaccagattgccacgccagaaacaaggcacgggtctgctacaaccgcaactgttcttagagccgcatggtctatcgtggtagctcgtcattccaacaccaatgacgtttgcttcggtgctactctctcgggccgcaatgcagcgcttgagggactccagaacatgccaggtcctgctatcgcaacaattcccgtacgtgtcaagttagaccaaagcacgctagcgaaacagttcttggatgacgttcagatgcaagccaccgagatgacagcttatgaacagtttggcctccaaaaaatcgccagagttagttcggatgctcgagatgcttgtcaatttactacgctcatggtgattcgcccgaagccgttccttgaggaagcaagtgactacacgattttggagatcggcgaagccacaaacattaccgaagaggaaatggtcaactacttcaactatccattagtcttggaggcagatctcatgaagggacacatcaaagtgcgactttgttacgatattcgtgttctgtcgaccgagctagttgatgcaattggtgagcaattggaactcgttgtgacacagctgttcgcaaagccatcaactccgattggggcaatcaatctcgttggggaatccgacatgcagcatgctctaactcatcaaaatatgaagccatcaaccaatcggctaatccatgagatgattcgtgagcaaattgccaatactcccgacctccccgccatcacatcctgggacggagatatgaagtaccaagagctcggctactatgcagagcgtcttgctagtcacttgaagacgcttggcgtcggtccagaggtgttcgtaccaatttgctttcccaagtccatgtgggctgttgtctcaatgattgctgtaaatatggcaggtggagcatttgtgcctctcgacttcaattcaccagctgcgcgattgaagacaattctagccgatacgaattcgaagatcgttctcgcatcgtcctcgtgtgaggagctagcgaatgccttggaggttgatgtcattcttgttgatgaaaccttcattcgagctctcccggatcccgaagaactacctgtaagatcctctgcgacataccaaaacgctagctttgttatgttcacttcgggttcaacgggcaagccgaagggaatggtctttgaacatcggaatacctgctcaacgtcaaacagccacggagcaatccagggttggggtccaggaacaagggtgtttacttactcggcttacacctttgacattggcgttatcgatatcatggtctctttgtctcgcggcgcctgcctctgcatcccctccgaatggcagcgttataacgatatccacggtgcaatcaataagatgcaggccaactggacgttctttactcccacgctcgcgagactggttagtcctgcacggattcctacgattcaaaacgtaggattaggtggggagaatgtgacaaaacaagttgtagataactggaagggtcatgcaacacttcataatttatacggtcctgcggaagcttccatctgtggttggattgccgacgtaggtctgatatccaagccaagcaatattggaatcccatcctcatgcgcctggtggatcgtcaaccccgaaagccctcgacaactcgtccccattggttgtgttggagaattgatgatccaaggtcctatgatggctcgcggatacattggcgctgatgaaaaggcgcagaaggcatggctgcacaacgttgattggcttcctggggacatgcctaagaaggcatatcttacaggagatctggtacgccgccttgctgatggcactttcgaatacttgggtcggaaagacgatcaagtcaagcattacggtcagcgagttgagctgggagagatcgagtctcacattgaggatgccctccccagcaacatgaatgccatcactgacttcatccgcgaggagacggggtcaaatactctggcagctttagtttggtacaacaccgggccttctgccgatcccccgtcgcttcagctcgccgaggtagttacagacgagatgagagacacgatggcgaagcttcaaactcatctgagtcgtgccctccctagttacatgttgcctagcctttatttgtttttcaccggaacccccgacaaaatggcctctggtaagattgatcgaaagaagcttcgcgcgctggcgcgatctacgacaacgaaagacaagcttcgctttgccaacggtgagaaagcgtttgaggaaccagtaaccgaaatggaattcaaaatccgtgacctctgggctcaaattctttccatcaatgctaccgatattgggcggcacgatagtttccttcgagttggcggtgactctgttagcgcgatcaagttggtttccgccgcaaacgaaatcggaattgctctcaccgttgagatgatcttcaaggacccgagactttcggcaatcgccggcggaagctcaaatgtggacaaggcattgtacgacacaaagccatttgaactccttgcgccgcagggcattgagaacattctgtcaagcattcaagagcagtgcaatctctcagaccggagcgttatagaggacgtgttcccctgtacgaagatgcaggaaggccttctggctctggcctcacgtaactcgggatcttacactgcccgtcagatcttacagctctcacccgacgtagatctcacggtattcaaactggcttgcgaggcaactgtggaactgtgcggtaatctgaggacgaagatcgtacaagtggatggcaactcttaccaggctgtcctaaacgagcctcttatgtggcacaacacagataatcttccactgaatgagtacctggacttggcacgcggtatcaagatggggtatggaattcccctcagttactttgctatcgtggaggaagatgacaagaaccgcttctttgtctggactggccaccatgccatatacgacggctggtgcattcagatcgtcctccacacgctttctgaggtctaccacggactcactgtctccaaaccgttaccattcagccatttcgtcaagtttgtcaatgacatcgacaatgaaggtgcaagcgagtattggcgaagtcaactccaagatgctcagcccgcatcattcccgccacgaggccataatgacaccaacggtaaccgatacttcagcacgactgtaccttgtcctccatccgccgacaattcaatcaccaaagcaacactaattagggcggcctgggctattgtacttgctcgacactcgaacactgatgatatttgttttggtgcaactgtctcgggacgtcaagctcccgttccgggcatcgagagtctatctgggcctactattgccactgtcccagttcgcatccagctagacaaggacatgaacacgaactcctatctccagtcaattcaatctcaagctatagatatgacccgctacgaacagtatgggctacaaaatatctctaagctcgacgcggagatgaaggacctttgtgacttttcgagtttatttgtcattcaaccagctcggcagtacgtcgattcagatgacgactccctatttgtacctttgcaagagactaaaatcaccattgaggagtctcttgatggattctcggactatcctcttatatgccaagtgatgcttggagacgattccgtcggccttgagtacagctacaagacagggttggtgcatgagtctcagctcgtggctatttcacaccaactcagccatgtgattgagcaactttccagccaaactggtaccatgctttctgatatctcagtaacgggccaatgggatctccttcaagccgaagcttggaacaaagcccctctcgcatccgacctttgcgctcatgaactgatttcccagcatgccaagactcgcccaacagcagaggcaatatactcctcagaagtatcactgtcatttttggagcttcatgacttgtccatgagattttccaagcatctctcttctctcggcgtaggaccagatacagccgtaccattctgttatgaaaagtccccttgggttgttgtcgcgatggtagccattatgaaggccggaggctacttcatccctctagatccacaacagccagtagatagactgagggagttggttaatgatgtcggtgccaaacatatcattatgtcccccgagacgctcagcgtgtgtcgtggcttggctcccactctcatcgagctatctcagcagacaatacaccagcttcctaagacccaaggtggctcgtcagaagatgtgaacgtttctccaagaaatgtggcctatttattattcacttctggctcaactggaaaacccaaaggtctcatggtggagcatgccgcgatcagcgccgctgctgttcatggccacgggaaggagtatggatatgatcattcaacccgcatgctgcagttttcacattacgtctttgacgccagcataactgagatcatctgccttctaatacgaggaggcacggtctgtgttcctaatgagctcgagcggcttcaggggacagtagagttcatgaacaaggctcgggtcaacatgacactactcaccccttcttttgcaaagacattgagtcccgctagcttgccaaacctgaagagactgattcttggtggagaacctgttacaagagacgtcattgataagtggtttgaccatgtggatgtgctcaacgcttatgggcctgcggaaacatgcgtctgctcgaatgtctaccacttccaatctaaagatgacgttcccgggataatcggattcggtgctaatactacctgctggattgttgatcccaccaatcaccaacagctggcacccattggctccgtcggtgaacttctgctccaaggctatgtcgctcgcggatatatcaacaatgaaacgcagaccagtaaagtgttctttgacacagtcccctggcttggtccatcaaagccctcagatggcaccaggttttacttgaccggagatctcgttcgatatcagcccgatggaacgctagaaattcttggtcgcaaggacacgcaaatcaaactccgaggccagagaattgaaccaggggagattgaatacgccatcaagaaactccgcccagagctcgatcacatcgctgttgatattgtcaaaacggatctaggcgactctctcgttgctttcttcccccaacctagcttggaagcggatagtactgaatttttcggcacgctcaattccgaagagcagacaagtatccgacaactgtcttctgatttgagttcaactctcccgaggtatatggtgccttcgcacttcttgccagtcaagtcgatgccatttatcaacgccatgaaacttgataggaagaaactccgacagatggcaaccactctaacgtcggaagagttatcgtctttcacgttgcagcacacaaaagcggcgcccacaacagaactggagttcaagttgcgcgacatttgggccaaagtactcaacatacgggcagaccgaatcggcaagagtgacagcttcttgcagattggcggtgattccatttccgctattcacctagtatcacaagcacagaccgaaggtattgggctgagtgtgctggacatattcaaggactcccgtcttgaaaccatggccagctactgttcggctctcgactccattacaacagacgacaagatcaatccattcggcctgctctccgatgagcttgctgatatcgagaagaccaaggcagctattcgcaaggcgtgtgccttgaaagaagaacagacagtggaggatgcatacccctgtacacctcttcaggagggcctcatagccctctcggtcaagcaacctggttcttatattgcgaagaatgctttcaatctatcggccgatgtcaacattgaaaagtttaagactgcctgggagcgagtcgtcaccctctgtgccaatctacgcacccggatcgtagaagccaacgggaaacacattcaggcaatcattgagcacgatttcgaatgggatactttccacccctctgatctctctaaagcattggagttgtcgacacaggttagcatgggttatggatcccggctaagtcggtatagcattggtcagaatccacacaacaaccaatactatttcatttggctctgccatcatgcagtttttgatggctggaccatgagtgttgtcatggatttgttgtataggtcttactacgaccaggaacttccttctatccgtccgtacgctaatttcatatcctatgtcatggatatggacttggcagcaactcaagagtattggaagaagtcactactcggcgcgcagaaaacagcattcccgcccaacaagtcttcccagaaaccgggcccctctcgcagttttacccagtcgatccagttccctaagtcgactgccacatcaataaccaaggctacagtgctacgagcagcttgggctattgtgctctctcgttactgcgagaccaacgatgttacatttgcagctacggtttcaggtcgaaatgctcccgtggtaggcctcgagtcaactcccggtacggtcatctcaaccatccctgtccgtgttcaattagacggagatcaaacggtcaaagcgttcctgcagtctatccagtcacaggcttctgacatgattccatacgaacaatttggtctccagaatatctccaagttgggcaccgatgctaaggaagcttgcgatttctccagtctaatggttgtccaacctgtccaacaaatgggccttgccggaacagttaacgatcaactcctgctgcccgcagtcactacaattgaagggaacgaaaggtctttgcaagggtacttcagctacccattggttatccaaggtgctctgtcagaccttggggctgaacttttcctcacatacgactcgggtcttctacaggagcgtcaagtttttgggctttcagagcaacttgcacaagttgtacagcaattaaccaatcttcatgatgtcaaacttggcaatctttcaatgacatcatcctgggacatccaagaggcgaagcggttcaatttgaacaggactcctcggatcattgacaactgtatccataaggtcattgaagcgcaagcgatggaccaaccccgagctcctgcaattcatgcttgggatcatcaattgacgtatgatgagctcaacggctatgcaaaccagctggcccatcatttgattcaaacgttgggaatcaaagctggagacgttgttcatgtctgcttcgacaagtccgcatggtattatgtgtctatcttagctatcaacaaagccggtgccgtgtggtcacctctagatcccgctcacccaacgcaacgcaagcaatatctcgttggtagaaccggctccggtctaattttggcatcagagcatcttcagaccagctgtacggatctagtaccgaatgttcttgctatcacagctgattttatgcttcgacttccacatgatgcaaccgtatgccctaacatcgagacctcccctgacgatatcgcttatattctgtttacttccggcagtacaggtgtacctaaaggcttcgttatgtctcatcgagcactatgcaccagtcaagctgcgttgtccggaaagcttggtttgaaccagagaatcagaatgctgcagtttgcgtcctatgtgtttgatttctcaattggtgaaatcttccattgtttaggatctggaggctgcctttgtgttccttcagaagatgaccgattgaacaatataagtcggtttatttgcgatgccaatatcaattgcgcctacctgacaccgtcattcgcgcgaacaatcaaccccgagcaagttccatcgctcgagatgctcgtttttggcggagaggctgtaaccaaggacgtatttgatcaatggtttggcaaggttcgattgctgaatgcttatggccccggcgaggcaagcactatttcaaccgtttacgagtaccaatctagcgacgactctgccggtaacattggtacacccatcggatgcatgtgctggatcgttgaccctcaagactcttctcgacttgcgcctgtgggcactgctggagagctcattattcaaggccctgggcttctttcccactaccttggagatccagagcgaacgcgggattcggtaattgaacaagtacatgagtgggcccatgacaggcacaagccatatatgggaagagcctttagatccggtgacctgtgtttctatcgagcggacggaaatattgagttcgctagtcgaaaagatactcaagtcaagatcagaggtctccgtgtcgaactcggtgaaattgagcatcatatactctcgctacttgagggagtatctcaagttgttgcggatgttgttcgatctggagactcttccaatgttgtggcctacttttcgttctccgactcgaacaagggcgactcgatggacctattctccgaaatcacaccagagctttcatccaaattgaccaagcttgtcggtgagctgaaactcgtccttccaagttacgaggttccttccatttttattccttgcaactacattccagtcaatacatcatctaaacttgatcgcaagatactaaaggaacgtaccgatttactggaccgagagaagctccatcattactctcttgttagttcctctaaacgaccaactgaaaccgaaatggaagctcgccttcaagctgtctgggcctccgttcttgggttatcaaaagaggctatcggtcgagatgatagtttcctgcagataggtggtgattccatttctgcaattcacgctgttgcggctgccagagaggctgggatcgagacagccgtcaaccacattttcaaagatccgcgactctttgtggttgcctcccttgccactgatgtagatattgaggatgagaatgacaagcatagcattagccagcccttcgacatgatacccacacagcttcatgaggtagaatgggcaaaggaagctcgcaatctttgccgcctccagcccgatgaggtgattgaaaacgcaatgccagtaacggcgttccaggagggtctaatggccctcgctgtcaagcagcctggctcttacattggtcaatggatatacaagatacccgataacattgatattcctcgattcagggctgcttgggagcgaaccgtcagaatctgcagcaacatgaggacaaggatcatcagtatctcgcaaaccattcttcaagtaatcatcaaggatgactttacctgggagcagactgaaggcctaattctctctgagtacattgagaagctgagcaacatggaaatgactcttggcacgcgactcaatcgctgggctctgatcgaggaaccgtcaggaaataactactttgttcttgctgctcaccattccacctacgatggctggacaatgagacttctgcttcgcacagtggtcgaggcatatacccaggctgacattgttggtccgaaatcatttgacaggtttgtcaagtatactcaatctttggatcaaggcgctagcaagcggtattggcttgatcaactcaaagatgccagccgggccacgttccccaaattcagccagaacaagtctgaagacagtgaagctcaagtcatcaataaatctatcgctctgccgccttcgtctcatacatcaatcacgaaggctacaatcatgagagcagcttggtctcttatcctcgctcaatactgcgatacggatgatgtgtgctttggcacatcggtttctggtcgtcaagctcccgtctctgacattaccgagatcgccggaccggtcgtggccacggtacctgtgcgtgtacgcatcgaccggcagacgtccgtttcagacttcctacaggctgttcaattacaagcaactgatatgatagctcacgagcagttcggccttcaaaatattttgaagctcgacgacacgatccgtgacgcatgtgccttctccagtttgcttgttattcaaccgtatgaaaagatggccgaaatgggtagcgaatccggtgcaattctagtcccatatgctcaagatgggcagtctcagtcaatggatggatatttcagcttccctctagtggttcaaacactaatctcggatcaacatatcgaacttaacttaacctacgagtcagccgcactgagtgaacgaaccatgactgggttagctaaccaactcgagcatatcatcaggagcttggccgccgaaacaactaagtctctacaggacttgtcaatggccagtccatgggatcatcaacaggtgacagattacaaccatgaaattgctgaagtcattgactccactttccatgaattggtaacagaacaagctcgaactcgccccgactccatcgcaatccaaacctccgaagttgcattgacttaccaggagctggatgaattgtccgacaaacttgcagcccatttgacaactacttatgcagtttcacgaggcgactttgtccacatctgctttgagaagtctgcttggcacttcgtatccttgcttgcaatcaacaaagccggcgcagcttgggttcctctggacccttctcatccgcttgaacgacagaagcaggtagtttctcagacgaaggcaaagctgatttttacttcagcgctacatgaagacctcggtgccagactcgtgggagaggttgtcgtagttacagccgaattcctcaacagccttgctgcctccgatagcttccaggcagcctcatctccgggcgacgcctgctacgctctatttacatctggtagtactggaacaccaaagggtttcgtcatggagcaccgggccgtctgcacaagtcagagagccattggcaacaggcttggccttacccctgaagtaaatatgctgcaattcgccgcatttgttttcgatctgtcaattggtgagatcattggtcctctaatcactggcgctaccatttgtatcccctcagatgaggtccgcatgagtactcagagtttagttgacttcatctccgaacatcgggtcaattggtcatacttgaccccgtcatttgcccggaccatcaagcccgattcagttccttctcttgagctgctactcttcgctggtgaagctgttcctcgagacgtctttgagacttgggtcacaaaggtgcgtcttatcaacggatgggggcccgcagagacgtgctgcttcagcacattgcatgaatggacctcggcagacgaatcaccacttaccctcggacgacctgtgggtggtctctgttgggtggttaaagcagatgatccccagaagcttgctccgataggcacactcggtgaggttgttatacaaggtccaactctgcttcgagagtatctggcagatccaaagaaaacttcagaaactaccttcacagacgtgcctaggtgggcatactcgggagacgagcattggggacgtttctacaagtcaggcgatctttgcttctacaattctgatgggctcctagagtttgcgacacgaaaggatactcaggtcaaaattcgaggcttgcgcgttgagctgggtgagattgaacatcaaattctctccaatctaaccacggcccgccaagttgctgttgatgttttgaagactgatgtagggactagtttggtctcttatatctgcttcagtagccagagcaggatctcacagcagtccaatgactatcgggatctatttgcaccaattggcagcactctccacagcgaattatcagcaatggtgagcaggctgcaaattgtccttccccgatatatgatccctactttcttcgtaccgtgcaattatatgccattcatcacatcttcaaagttagacaggaagacgctccgagccgaggtcggaaagctggatcaggctcaaatacacgaatatgccctccaatcaggagagaaggaggcaccacaaacagctatggaagtcgagatgcaaaagctgtggtcgacggtactgaacctcccaaccgagtctattgggcgcggcgacagcttcctcgccttgggaggtgattccataactgcaatcaatctcatgaccgctgccagagaacaaggtatcgaaatcagcgtcaatgatatcttccgcgatccccggcttttgagcgtttcgcttgtggccaatacctcggctgagccacttgaaaagtcgaccgatattcagccctttgatcttctgtcccccgaagaacgaagtatggtgcatagcggtgctcttcaagctcgatgtggcctctctgagtcatccgtaatcgaagactctttcccttgttctgctctgcaagagggacttattgctctctcggtcaaacaaacgggttcatacataactaagtatgtgctcaaggttccagaacatgtagacctcgctcaattcagagttgcatgggatcaaaccgtgcagctttgcacgaacttgagaactcgcatcgtttcttcaaacaatcgctcccttcaagtaattttcaagggtgaggttgcctgggagttcacggagggactcggactgaacgatttcctcaaaacaacacaaagttacgaaatgaccttcggttctcaactcagtcgccatgcaatgattacggaacacggtcagacctatttcgtgtggatcacacatcattctattgtcgatggatggtgcttgcagttaatcttccgcactcttcatgaatgctactggggacagcctcacaacagtctggctccgtatgcgggcttcatcaagcatgtccgtaacctagaccttgagcaggcctctgccttttgggcaaaccagctagagggagcctcacgcccttcattccctgccaagtcgagtagcgatgagcccaatttcaagtttttagatcacaacatcagcaccccttccatggtgggaagctcagttacgaaagccactgtgctcagagctggttggtctgttgttctctcacagcactgcaatattgacgatatctgctttggtgccacactgtctggccggaacgcggctgtggatggtttgcagaatatgccaggccctgctattgcaacaattcctatccgcatcaagattgatcatgctgcttctgtggcaagctttctgcaagatgtccaagcacagtctactgagatgacatcgtgggagcagtttggtctgcaaaatatcgccagggtcagcaaagatgcaagagatgcatgtgactttaccaccctgatggtgattcaacccaagcagcatcttgatactgacaacaagggtgtaatcattgatggaaacgaaggagtgaagacaactgaacaggaaatggtcaactatttcaactatcctcttgttctcgtttccagcctttacaaagaccacattcatgtgagccttgcttacgacacgaatgttctatcaccaaagcttgtcgaagctctagctcatcagcttgatcatgtcatgcagcagctgttttcgaagagtacgcagctcgagccgatgagccagctgtcgcttgttggaccctgggatttggagcatgctctgcgccatcagaacatgaaaccatccaccgatcgctgcattcacgagatgatccgagaccagatcaaaaagactccggatttaccggctttgacatcttgggacggcgacatgacttatgcagagcttggtcaacactgtgagcgtctagcaaattatctgctgtctcttggtattgggccggaagtctttgtccccatttgtttcaacaagtcaatatgggctgttgtttcaatgatcgctgttaatatggctggaggagcctttgttccactggacccttcttctcctgtagcgcggttaaagggtatcttaagcgacaccaactccaccatgatgcttgcttcaccggagtgcttcgataccgcgaaagctcttgatatcccagtacataccatcgaccatgaggcaatcatgaagcttcccgagccaatctcggctatccaatcgtccgtgaccttcaccaatgccagctttgtcatgttcacatcaggttctaccggaaagcctaaggggatgatcttcgaacacagaaacatatcctctacttccaatagtcacggtgtgatacagaaatggggccctggaactcgggtctttacatactcggcgtatacattcgatatcggtgtaattgacgtgatggtatcgctttcgaggggagcttgtctctgcatcccctccgagtggcaacgctacaatgatatacatggagctatcaactccatgaaagctaattggtctttcttcacgccaacattagcaggcctcgtcaagccgtctgagattccaacgattaagaatgtaggtctaggtggcgagaacgtcactaaacaggttgtggataactggcgtggccatgctacattgcacaatctctatgggccagctgaagcatcaatttgcggctggatcgccgacgttggaatcgtttcaagacctagtaatattggtgtcccttcatcatgtgcttggtgggttgtgaatcctgaggatcatactcagctggtccccgtcggttgtatcggcgagttgatgatccagggaccaatgctcgcccgaggatatatcggtgacgccaatagcagcgtgtggctgcacgatgttgaatgggtacctggcaccgcgtctaagaaagcatatgtaactggtgatcttgtccgtcgactggaagacggcacctttgagtatctaggccgaaaagatacacagatcaagcttcacggtcaacgtgtggagcttggagagattgaatcccgcctcgaagttgttctaccacagaacatggcatgcgttgtggatacaatcatcaacgaagaagcgcaaacgaacactttggtggctctcctttggtataccaggggtgaaacttctgaggctcctcaacttgagctcgttgataacgtgtctgacgaaatgcgtgctctcatctctgagatagactcttcattgagcctgtcgctggccacgtatatggtgccaagcatgtatctaatcttccaaggaatgcccgaacggaagagctccggtaagatcgacaggcgaaagctacgtgccttagcccatgatgctccagcgaaagaaaagctcaagtttgctcctggaggcggagaagctggtgcccatgagcccgtaaccgatcgcgagtacgaactcagggacttgtgggctcaagtcttgaacatcaacgccaatgacatcggacgtcacgacagcttcctcagggcagggggtgattcaatcagcgctataagattagttacccttgcacgtgagaagggcctcagtctagatgtaggaagtattttcaaggacccccgactatcaccaatggcggctgcttgcggcgtcattgttgatgccgcgccacctccccaatgtgaaccgtttagcctgattcctgcggaccgcagaatcgatattatgtcggaagctgtcattcaatgcggtatccagaaccagactcaaattgaggacatgttcccttgcacccaactccaagacgggcttttagcactcaccgtcaagcaaccgggttcctatattgctagacatgctttccgtcttgctaacacggttgacatttcgcgctttgagcgcgctctgagggaaactgctaatatctgtgtcaatcttcgaacaagagtaattaaatgccaggacatggccttccaggttgtcattaaggatgatgttgaatgggatggtattcataccggaatgaatgccacaggtctgatgagagcatccaagaaaatcaacatgacctacggctctaagctgaatcagttcagtcttgctcaagataagagtggaaaatggtactttttgtggcttacacatcattcagtgttcgatggctggagcttgggtatcatcctagacactttgaggagagcctacgaaggaagcgcattacctatcatcagcccgtacgtcaacttcatcgcatacacccgcagtattgatgagtcggctgctagagccttctggggacagcaactacaggatgctcggcgagcacctttcccatcacaacgagcaaacgcggtctcttctgatgactccatcacaggcgtgctcaccaagtcgctcccattcacacaatcagcccgaacctccatcaccagagccacagttcttcgggctgcatgggctattcttcttgcaagatattgtggtactgacgatgtgaccttcggtgctacggtctctggccgcaatgctcctgtgattggtatcgaggacattccgggagcgatgattgctacgttgccgatccgtgtccgtttggacttccaaaaatctatcaaagccttcttagaagatgttcaacttcaatcatcagatatgattgcatttgaacaattcggtctgcagaatatttctaagataagccatgacgcgaaggaggcatgtggcttctccagcctcattgttattcagcccggacaacagaagagcccagtcgacgtagcacctgacacagaagacttgcttgcttctgctggatcagaggaggatctggtggaaaactctctccaaggctacttcaactaccccttggtcatgcaatgcgcattacatgaggacaaggttgagctatacttcttctacgagaccagttatttacaaaaggcggaaatggatggtatggcccatcaatttgagcaggtggtttctgaacttctctccgaagataacctcagacacctaagcgaagtctcaatcgcttcaccatgggacatcagcaccgcgattgaccggaaccagactcctgatgttgtcgaagattgcctccacaacatcatttcctccaacgcaattgaacgacctgaatctcccgctgtgtatgcttgggacggcgagctgacatacgctcaactcgacgctacctccaaccgtcttgctcagtatcttgtagacgagttcaatgtcatggttggtgatgtaattcatgtttgtctggacaagtcgctgtggtacattattgccattctcgcgatcaacaaagcaggcgctgcattctcaccaattgatcccagccacccgctccaacggaaacaacagatcgttgagcagactcaagcgaagatcatgctcgtgtcacccaaatacatgcaagatgcagctcaggtcaccgaacacgtcattccactcgacgctatgctcgacgcgcgcttgacaccagtgacgaagagtccttcgactggggtatctcccacagacgttgcgtacgtgctgttcacgtctggcagcacagggcgtccaaaaggctttctgattgaacatcaatccatttgcacgtctcagcgcgccctcgctgcccgtgttggccatggacctgaaacccgcgttctccaatttgcaaacgtcatctttgatttctctatcggagagatcttccaggccttgacaagcggtggctgtatttgtataccatccgaagagatgcgctacaacaacatccaggagttcatccggcaagctgaggtcaactgtgcgatgctaagcccttcattcattcgcactcttagacctgaagaagtcccatgtatcaaagctctcttcttcgccggtgaagaagttccgcaagaactctttgatgaatggtttggtaaagtgcgcctattcaatgtttggggacctggtgaagccgcctttgcctgctcggtatatgagtaccggtccaagtacgactctcctgcaacaatcggagaatcatttggtgcttcgtgctggatcgttgatcctgatgatccaactcaactcgccccaatcggcaccgtgggagagatattgatccagggtgctactgttctccgcgagtaccttggagatcctgtcaagactcaagcctcaacacttagccatgcccctacttgggcggcgagtaaagaagtcggggtcctaagtcgattcttcaaatcgggagatttggccatgtacaatgccgaaggacaaatcgagtttgttgctcgcaaggacacgcaagtcaagattcgtggattacgagttgagctgggcgaggttgaacatcatatactcgctctcctcggtggagtgaaacaagtcgtcgttgacgtgcttcgaaccgaggaggttccaaagttggttgcgtatctggccttctctgacagcaaacgcaccataactgaatctgatgaaatattctctgccatcacctctgagatcgagtccaaacttgttgagatgagaggcaggcttgaattgatcgttccgaactatatgattccttcgaccttcattccatgcaatttcattccgataagcagttcctcgaaacttgatcgaaagatgctgatccacaagacaaccggcctcacgcgtgaacaaattcaccactactctttagttgatgccgtcaagagagcaccggagacagccatggagatccgcctccagtcgatgtggtcaacagtcctcaaacttccaatagaatccatcgggcgcgatgatagcttcctccaaatcggtggtgactctattctcgctatccagctggtatctctagctcgcgaatcaggggtctccttcaaggtcaaagacattttcgatgactctcgcctctccacattagcggctaaagccacggaaatcgatggggatatcgtggaggatactattgagccttttgaattgatttcgcacgaccaaaaggaattggtactttccaacatcatcagagagaaatgcgctctttccgccgatcaacaagttaatgacgcgtacccttgcacgtcaatccaggaaggcatggttgccctcgcggagaaacagccagggtctcatatggccaagtatatctaccgcctcgccgatgatgtcgatgtcaaccggttcaaggctgcctgggagaagactgtccaattctgtagcaatctccgaactaggattgttcaattgaacggaaaagcaatccagttagtccttgacaacgagagcgaatgggattcccccgacaagaaggatgtttcttcatccatcaagagtatgtctcagccgccaatgggattcggaagccgtctgagccgtcacggcctcgtaagcaaaaataacgtccactatttcacatgggtcatccaccactctatctacgatggatggtcatcacaattgatcctacgaaccctgtttgctctgtatgagaatagtcagccagcatctttgtatccctactctggcttcattaagtacactatgagcgtcggggaagatgcctcacgcgagtattgggccggtcaactgcaagactcaaaacgatcctcatggccgccaattgtgcctcgatctggggtacggacagacaacccaacgagggttgtagagagaacgatccacttccccaagactaccagcacgtccataacaaaggccaccatcgttcgcgcagcttgggcaattgtgctcgctaagtattctgaaacaagtgatatctgctttggtacgagtgtgtctggccgtcaagcccccgttgctcatcttggagatatgcctgggccggccatcgcaacagtcccagtccgtatcaagattgatgggcagcagtcaatttacaaccatctaaagcaagtccagaaccaggctattgacatggttccttatgagcaatatgggttacaaaatatctccaagttgggtcgtgacgctgaagaagcgtgtggcttctcctccttgcttgtcgtacaacctacgcaacaactagccagcattggaggccaagcgtactctatgcttggagccgcagatgatgcagacaacatgagcatggaggattccatggagggctatttcacatatcctctagtcttccaaggccgaatttccgaagatgcggcagagctgattgccatctacgatagcgatatcctgagcgagatgaggatactggccatgatcaaccactacaattttgtcgtgcaacaactgatcactgaaagtgacaagacggtcggctccattcacctcgcagcagattgggatatgcagaagtctatagagtggaatagtcacccgaccgaagtggttgaccgctgcttccatgaaatgttcgaagaacgagccgcgatccagcctgaggcgatggccattgactgttgggatggaaaactgacatatgaccaactcaacaacgcagccaacagactcgcccatcaccttttgaggacttacgacgtcaagagccaagatctgatacacgtatgctttgaaaagtctgcctggtactacgtctccattctcgctattaacaaggccggtgctgcctgggtccctctagatcccgcccatcctgaagagcggaagagacaagtgacgaagcagacagaagctaagcttgcgctttcgtcccctcaaagctcgcacttggtcttgccactggtcgccacagttgtcgaggttagctcgcaactcgaccaggagattctcaattcaccccagtgcagcgatcagaacccaggggttgcagtctctcccagtgatgttgcatacgtgctctttacatcaggcagcacgggcacaccaaaggggtacatcaatgaacacaggtcattgtgtaccagtcaaacaaatatccctcgcagccttggtattcccgctaccgcgcggacacttcaatttgcatcctatgtagttgatttcgccatcgctgagcttgcaagtacgctacttcatggcggctgcttgtgcgttcctgacgacgaaacaagaatggatggcctggtcaaattcatcaacgataccaacgttaactgggtcttccttaccccatcgttcttccagacgatgcgtcctgatcaactgcctaaccttgaagtggttgtgcttgctggtgaagccgtttcccaagacctactcgatgcttggtttggcaaagttcgattagtcaacctctggggccctggtgaagttatcgttggaacaacatggcatgagtacacttctaccaaagacatcccaaccaacattggtcgccctgtatgcggtcatacatggcttgttgaccctgaagatgcctcaaagctggcaccaattggaacaatcggtgaaattgttatccagacacccacaatgctacgcgagtatctgaagaaccccgagaaaacaaaagaggcaatcatcacagacctcccaagctgggtcccccgccgtaccgagccatcgtgggatcgtatttacaagacaggagatctggcgtactacactgctgatggttgccttgatttcgtatcacgaaaggacacacaagtgaaaatccgcggattgcgtgttgaactcggtgaagttgagtatcacatccgcgaaacccttcccgatgtacggcaagttgctgtcgacgtgttcaagacggacataagcgtcaacctagttgcctatttcagttacagtgatacaatgcgaccgcaagtcgccgctgatgttttccttccactcgactccaagcttcgagaggccatcgccgagctggcaggcaagctggatgttgtgcttccagcatacgaggttccaaccatgtacattccttgcgcctacatgccagctaacgcctcagagaagttggatagaattgcattgaaatctctgacatccgatttgagtcaggatcaactaacaatgtattcgctttccagcactgagaagcgagcacctgaaacagatatggaaaggaacttgcagcttatgtggtcccaactgcttcgtgtacctccagatcagattggacgggatgacagtttccttcgcattggaggagattcgattctagcaatccagcttgcttctatggcccaagaacagggcatacggatcacggtcgccaacattttcaaagactcccgcctttctgctctagccaacgcagccgctaatggcgctgagtatgctgccaccgaagtaaaacccttcagcatgcttccatccgaagtttctgctacagatgtatcagttgagatccagaaacaagggggcctacccaaccttccagagttagaggacgcattcccaacgtattcctaccaaaactcaatgatggatcttacccacaaactcgcaggagcgtacgtgacaaaacgtgtctggagacttcccagtcacgtcgacgtgcaaaggttcaaagacgcatgggatagaaccgtgcaatacttccctaatctaagaacccgcatccttcttgtggatggctcggaaatccaagccgttgtgaagggcaagcaagattgggaagattcaaagggattaggtgtcagagatttcatccacgaatccggtatcgctttcaacatgggacgtggcagttgcttgtctcgctatgccattattgaagaagcgggcgaaaccttctttgtctggattcagcatcacacgatcatggacggttggtctcttaacatgcttcttgccggggttcacgctatgtatcacggtacaatgcccgctccgatcaacagcttcgccaactttgtccaatatgccaatggaattgatcaagatgctgccgcatcctactggaagaataccctggaaggtgtcaaacaagtcacttggcctaagcccatcacctctgagacccgtcttcgtggtgttacagacaccaagacgcggacgattcgtatcccagagagcctcgactcttctctaactctgggaaccgtcgttctaggtgcatggggctttgctcttagacactttgacaacaaggatgacatttgcttcactcgcacatcatctggtcggcaggcccctgtgcatggcattgacaccacgcctggcttctgtactcaagctgttcctacacgcatccggttcaacaaagatcaaactatattaagtcttctaactgatctccagaatcaatgctctgagtcagtcccctttgagcactttggcacaaagaagattgcacagattctgccagaggctgcgccagccctgcttcagtccagcagtttgattattccacagccggtccgcgcttcgggcactggtgaagagacatctgcagcaagtttgctcgctcctgcgctagacaagtgggccgtggatgatatcctggatgggttcagactggttcctctctgctccaatttcttcctcaaggaggacacggttgacattgtttcaaactataatagggaagttatcagcagcaccgagattgaaacgctctatgactatctcgaggcgatcattgttggtatttgcagtcattcagatcttacagttggcaatcttcttgagaggttgaacttggaatagtcgcgagtggttgctttccttgatttctatttccttagattattcacacttattatggtttttattcctgttttctattttcttttctttttcactctttaaacatacttaggtagacaatatcctcatttacgaaattccataagaatttaaatacattttctagcttatccaactatcaagctcaaatggtttattgaagtgcaatagtgttaacgcgaccgattggtccacccagcccccaagaagtttatcccaggcttgggttatggaatacggttcagaacttcagttgtaagcagatgcacaaaggggcaaagtatgccgatttagcctaactcgccatttgctgattagaatctaaggtgtctttgctctcccacaaggtaccagggctggaacagaacttcatcctccggaggctccggtggtggtggctccccaaagccacaactccacactctacccagctcccgatgtccaagttgaatccagtacccttttaaacccccagaactattgtttaaaggtctccagtggcgctcctgcaagtgatgaagatgaatttgctcaacctcaacgtctccggctttcacagcctgcctcctccttctttcgtactccaagctaccaagtgcaattgtgcattgtctcaacttggggctgaatttggaaatcattctatcaatcggagtcactatatctctgtcggtgattttgatggactcggcctcattcatgtaaacctggcgtccattatgttccttcatgggcgttaaatccccccacaacgccatatagagtgatgtgaggttagggaaagtcgtaggaagagcttctaaaatcgcgtagaacgtacgcaggtcatcgagcggaccaacgacaacagtgttcggcgcatacggcttgaaataccagaccaattccactgatttgatcttagatagtctttgaggaagaagaagcctgtccaagtgcaggagcatttgcttgctagcggtatggatagtgttcgtgccatataacacatcgacgccctcgcagtacctaaagctcctggtcagctatattcttagttcagcgtgctggtatcgggagggatcctacgcctgtcggcagcttaacagccatcccattgctcctacaaaacacttgtgcggccgttcaccgggccaaagttgacaaaaatggccttcagcaccaccgaggcggcaacggtcctccgatgcattaaccgctctatctttgtacttgttgtgctcatcgcttctgctatcccacggcgggtttctgtggcaatcggaactgcgccagatccatctttttggcaatgaagaatcgactttatatctcagcgtctcttgtctatcctccccccctgtctcgcgattgtaatttccgtggttcgacagatgtttcatcgagccatcgaaatacgctttatccaagggccgttctggatggtcaaaagacaagtccatatgtatagtgtgcccaccaaatgcctcgaccaggattcggcgacgaatctcgaatgggagcttctggaagaagctggactgagcggtcgcatcggcagcaaagtcgcgtagatcctctctagacgacgacggcgtaagaactcgtggcctgccagctggtaaggctggcaccggctctgccagctcagggatgtaccgacgaaactcctcccttggccgtggctcgtccgctggtcggggatcaggtatctgtagccggagcaatctggacaatcttgctcgcatttcagccaatctctcctcgcctcctaggaagacggtgtcctttgctagcccctgctctgtcagatcggcgcctgagaagaacaggcgcgaaagattgttgcgtctttgaaatgcgaagttccgatggcttaattccgtgtcgctttcccttatccaacttggcccacagcttcagaccttgatgtgaccgggcgcgaccaccgtctgtctctgggaaaaagattactgagggtattgaaacagtggccgttactcctgattcgtcacgtggccaatttatatgtagcgtgcgaatggattaggtagaagtgtggataaaccaggttgagcacgccgaaacccctcatcagcctccgagaggctttcattgcgagcgaaccatatatgctactctcacttgatcttatgttctgtaacaacatcatagatgatctctaacagagagttttgcaatcatatctgtattaccgccatcaatcggcccaacttgcctcttctggtacccgacctttgatgggtcttctgggtggtgtttctggtattgggactttggtttgataacgaagtggagttgtcaagggtctaaacagcaagcacagccttcccaacactcatatcctgtatactcaaggcacctgtcaagtcctaatgaatattactggaggggcagaattgttttctccagtcccatagtaacctaaacacagatgcacgccaggcagcacacatcgtatctctctaactcaaggcagcgagtggccgtgcgaaccacatcgcatcatgcatcacaaggaacgaaatccaaactgttaaggcgcacttgaaataacaactatttgccaaaaagttttatcaaacgtctattagctagattctataggcttgcgctgcaaggaaccatctccatgatgacagtcttactaggcagatcgttccaaatagaaggtgacttgctttattgcattagacaaattgcggctgtgagagcgtgaataatgattgcacggggcctctaaaatgagtgccaagaagcacggccacttccatgaaatgtgaaaagtccctggaaggattgtctccacagcagcaccacattatcaactagaatccatttaccacgaaagattccttcagtacctggacttgaatataccccttcacgctctgtccaacgccatggccattcttggagaacataacccgttccttctgctgagccatcaatccctctatattgatggcgttaggaagaaaaccgtaccacatattttacaaggcagtaaaggctgtgaagaagtttcttgagactatgcagggttcgcgcggtgtctacatctaagacattgcctcatctcagggtccagactgtcagccctcccaggccaaaatccctgtcccccgtcaaccttggctcagacaggggtacaactttttaaagggctcaagataacactctgctccgttggactaagagaatagcacacatttcggttctcaaggcaacctcttctccaatatcaatctacgaccaatgcatacgcagctactaaatgatgctgtcgcttatcatcttcttcttctcaagccttgctctggcggcagactacgacgttaatgaactcacaaccgcttcccaggctaacgtccaaagttgcgttgcctccgttgcaagtcaagtcagaccgcctgagccagtcaacacccccttcaaccaatgggtcaccagcacattctctatgcctgcctgtactattacagcaccagctacgtactctgacgactttttgagctatgataaagctctatccacatggctttcaaccgttcagtctgtcgcggacaaaatcaacacgaattgtggctatgacacattatctttcagcttttccaattactgtctcacctcacgcactgttttgttcacacgtgcccaaacgatggggaccacaacctcctgggagacgatctcgaccaccttgcctccttaccaaacacatgatactatttacattggcgccgcaggccgccgtgctgataactctcgatttttaccggttgtagttctctcaacgactattatggccttatttctttgaggtgccgaggtcaaaaagccaaggagctggtaaataatatacttagaatgtacatatccagaaaatgcctacatacgaataaattactccattgtaaatcttgattcaatcttcttttgtttcgttcatcatattctatcaatcccttctacagttgataggcaacttattatttgttaccattcggaatcgacagcggccatgtccatactttcaacgtggcatgtaattggacaaatatttcagtgcaggctcccacacttcaggccaaagggaaagcccaaagaaaactattatgggtgggcaacgattttgtccccttctagttattgttgccttctgaaacatgggaagttgtttccgaggcagttttaggtcggttgatgtgttatgttgtccgattctcatgccacgccttctcgtttacacactttttgcacttcttgcacttaaacatatcttgttacggaagtcagttctcatcttcattaagatacattccaaaaacttccatgccaactcatcatgagacgctacattgccactctagccgatcggagcatttcacgctttcaatttcccgacacactatgagagcaactttcaggttagatcattgaagacgtgccagtgtctcttacaaattgggttgagttgcctgccattgaagtaagacaagttccattatccagcttcaaccaagtcgtacagatcatgaacatatggcacgcgttaagttgcatatatttagagggttctattctgaaagaaaaagatatttgactacaaatttcgtcagcgatttccgaaaccataggtcgatgtgccaccggtaaggcgggaaacaacgactcttgtgttccttcggattgtcaatcatcaagagagatcgaactcgtggaccaaaggccattctaaaattgataaatcttccgaagagtttcgacaagctccgtaggtcctctcacatcgccttcctcgtcctcgaaggtcccgaccatgatcccaccaggcagcgcagctgttgtcatatccaccagctcttgaattaccgaagcaggcgctcgctcggcaaagaacgaagccagttggtctttaggaacaataatggcctcaactacctttccagttatctcctcaagggcgctttttacgtcaagggaactgtagttcctcggtccgtagaggttgaagaagtgcggattggatggaagcggctggcctacttcgagtagtttctgggcacaaaccgtcccgatgtcttcgatgctaatctatgaacagagtcagataatacttctaatctcggaagtttcttgcgattgacataccattggaattttatgagtcgctggagagatgggggaataaaacactggtggatcaagctgcagtgtctggaatgcgtgctgccaattctcttggaagtaaccaggccgtgggatgacgacctccgcaacgctgtccttcaagatttgatccgaaatatagttgactcgtaagatcccctatgatttttaagtttttgaagttcaaggcatgagtgttgagcgacaacttacaatatccctgtcgtattgagagcccatgctcgagaacaagaccagcctcttaactgaagatgcctttgctagagcctccttcacgttctcggcatgctttctagcagtttcgcctacgtctgaaccatcgtatataggcggtggaatatacaagacggcatccgagttgctgaaatccagcgaagcgcctgaagcaatgtccccttggcttgcaatgaactttgggtgactcttaaactcagatggtattttggtaagatctctgtaaataccaacaactcttgttgttttctcgtcagaaagcaaggcagatattgtcgccttgccagcttgggtggaagctggaataactgtaagttgtgccattgtattggtggttgaaatctgaggcgattggactggagctaatgtgtctaaggattgggatcccagctatcatggctcgggaaacaccgagaatatatagacctcttgagtttttgcatccataaaatcattagaaattcaatatttgatatcacccgagccgcaagacggagtccgtggctgatgcagttattgtcccgcttcccgattatgtcaagttgactcatgcctccgcatagtccgcaagtccgcctcgagccatttttttgtcagtagatttacataattccgatttttactttctcagaataatcaaaaattcaaatgtatgtgtagactgatttttgtagtcctctctcactttttatcacaatgcttgctggagcactgaacaagatctgcggatatactatgatctctacgcacaaagttaaacacacaaaaagtcaatagatggttctagcggcgaataccagccacataccacgatcaaacaacgtaagggaaggcgctcatgagatcgtgggccggttattagaataagattttcgctcttgcaaatcaaggatgcagatttcaaacgaggatctccatgaaggttctcagtcatctagcctcctagcagagcagagcagagccactcacagagggagaattcctgcagcgctactcgtggattgagcataagtcgccaccctagtcaacggcccacccccctcaacggtccaccattgaatgtcccaacctcttcattttctatgcctgtaactgcgcgatttctcatgcaaattttattcttttcaattgaaaattacaccattcgattcgcaaatgactgggcattctgaaaataatattcaatcggctattcgtgatgtgaaagcgggctgttcgcagcgaacagctgcgacacgatggggaatccctcggacaaccctacgtatgcgtatggaaggtcgcaagacgcggcaacaagaggccgagacccggcagcggctctcgaagatccaggaagcccgtttaacgaaatggatccttgttcaagactcaattgggtttcctccgacccatacgaaggtcagagatatcgcttcgttcctgctgttcgaacagggtgaacttgaccccctcggcaagcactggatggagggatttttacgccgtaacccggaggtcagaacccttcaaggcaagagaattgacttcctaagagttgaaggagctacagttgaccgtatcaaggatttcttcgcgctcaagctaattcctgatattcaaatgtggtgttttttctgctgttcattgggggaggaatttcgggtctgataggtcgcacgtgatctcctcctgcgtctcctgctgctgataaatatcatcccaatcgtctgttgaatcctcctcttcctcttcagcccaaatctcatcttgacgtgccaataacaacctatctatatccgtgaggctcttaccctcagcatcttgtgactgtgactcgacgataggtccggctttgttcgttacagcgagaggctcgtcaggaggcgtacagcagcgggctgcttgagcccttcgaggagcctctgttccgggttcgagggtatcaccaaattgccgtatgtattgaagcccggtcacacgtggtgtctcgaggttggccggagcggttgacggcggcggcggcaaccgggactcaagagattcggctgcaacggctacttcgtatgacgagggatcgcgacgagtgcttcgtgttttatcgaggttgagggagccgcgaggtcttcctttccctttaactgtgacgggctcgaagggcactgtccgctccgttcgataggacttccaaatccaatgatcgtcaaagtcatccaaggtcaaagtgtgattattgaagagccgcgattgaataatatgtcggcatggaagcccccaagcaacagccttctcacaaatgcagccttgcgagacgaagaggctattgcgaagcggcttgaactccactgcccgatgttcattttcaatgatcgccaacgcccttgctgtcacttgctcacgaattggcagataaatcggcttgattgaaaaggttgatattttatgacgctgaattgactgaagattccgaatattctttatttggcgtttccagaagtcgttaaaccgatctatgagggtatcgaagtcacccttcgaagaccaaaggaagcgcttcatctgaccgtggagtgactccacgattgaagtcgtgatatggccgaagtgacgatggaggttaacgagataggttacaaacctatccttccaaggataaagccacgtattgagggcatagtcaaccggttgcttagggtgatcccgaatgaaattcgtcagccgtgtgttgaaggttttctcgtctcgcgatctagctaggcgaccccaatcgtgaaggaaggactgaaaggaaggatcccgttcaacgcggccgttgactctcttcgcggctggaaacatccttttacatttcgcaaggatattcatattaatatgccaacggcagagaaggttgacagatccggcaagacgaggttccccttcaatcccgttaattagggcgagctcgcgatccgtaaccgtgacacgaggcatagggatatcatacgaatccatgatattcaacagcgccgagatagcccacttgtaggtgccttcaacttcgttgttcaggaagaccgaagccactgtgaaggtcttgtttgtgcccgttacaccacatatgttcagaagcggcatattaaatcgattcgttttatatgtgcagtcgaggaggagcacatccggatgtagcttcaataactcgagcccggcttccggggcgatcagaagagatgtcagctggccctgagggttacagcggtcgcgaaagacgaatccgtccttattaatgcggttgtagagatactcgagaggtgagaggccgttgagtcgtctttggcgatactgtgctaacaggttggaaatatctcgagggaagacgtcagtcacagcttggccggctgccttcgctttttcgacttgctgatcaatccagacagttatttgaagcggcgatgaacccgacttatgcatcgagattatctggtcttcgaatcgcgaaatcgtctcgttacggaaggctgagaaggatgtcggatcttcgaactcgtggttatgtgtgttgttgctgctgcgttggataacgaagttgtcttgacccgtagccttgatccacaacttgaaaggacaggatgacttttgcgtattcgaacgacggcgtttcgatggatgagtattcggatcgtgttgacttcgatatgcccttgccttgcagcagcttagcagtctgcactttatgcctccttcttcatccctcttggtgttgcggatgatgagggcaaagccggcctccttgctgtatttgtcgcacgcagcctttgcagcctcggcagtggggaaaacctccttcaataggctatccattagtgaaaagatatcacgaaaagcttcacttttggcagagttatcgcgttgtcaataatgcggccttgtgacgcgttgggggtgtggtggtgagcaacagctggtaacgatccctgcaaaaaggggctgttattggtgtaaaaataggctcctttgcgatatcggctaccgagccccgctcagccacaattgggtggttaattagtgagacgaggtggtctgatagtgaggtccttattatatactaaaataaaaatagaactagaatttctctaaaaaagaataaaaaaatattataataaaataagattaaagagactaattttaaaggagggagataagatctatctactttataaaaatattataataataaagctaagtaataaattagattataaaaaacttaaactatttaaaattattaagaaaaaattaaatactaactataaactcttattactaaatataatatatatctatctagttttttatatcttattatttaaaaaagtattagaaaatactttagactaaaattatctaattaaagtctataaagaagaatataagctagaaaaaatcctaaagaaagaaattagaaataaataaatattttatttagttaaatagaaaaaatatattaactaagataatattaagagcgtatgtaatttccgtagttagttagggtaatttgctgcatgctacttaagcagcaaatttttactgctcttaaaatgaaaaaccgtctttactcttgaattattctttatttttaaaatcgtgatctttgacttattattctgcggccagtttggctcgtataataacctggatggtctcattcaattgatcaaatgcgggagtccctaaccaaacaccaaatacatgtgcaattgattgtggttgttggctttgactacgcagcttggttgcaattcctctcctttgaccgacgtcgataccgcgaccgcggacccacccggtctttggttgtggtgttgttggttggaaaattccaccggcactcatatggtggtttcgcccgggcctaatcctcaaagtaaggaattctaattgattaactgctatttggtctcttggatgactttgccctgaggagaaggtacttctacgctgctagagcaagaagaacctgggcgtgcctagtgggaatttctgactacctgtcctttgcctacgaaccctcctctcggccataaggagatattccggggattgctaacccacggaaaagacccttatcacccgtgctcaggtgttatctgcctacaagcagttagaacctgatcagagccagggcttcaaaaaccctgaccctgacgcctggaggcgaaattggtagaatggacaggtatacggtcactcgtggagattgcaatcagttgatcaaacccttctcgagggtagtatgatgctgacggatcaaaaaggggattattctcttgcagctctggaagcaggaagcacttcctaaggtgttatccaacgccgaggatttaaaagtatagattatagcacgattgagactcttcttctaaaaccagggacctctactaggactactctagccctagttccgttagatcatttggtgagaaccatttgatgagagcgagggtcccaggtcattaatattacttagaaccaccagggggaagcccagtggagctttgtaatttagaaaggaggcttgagagtggtatgataagtgccgacggctaagggttccttctcttctatgcagaaaagagaaaggagaacgggccagtctttcttctcgtcagatttctgacttgatcaaatctcttgagtcccacctattagattagtgtgggggaaaactgaagagtaatctacgatgaaagtcggattcttaatcttatatcggggttcggggagctatcagacccgaggaaagggaacaagcttacagggttaccaggatagtccagaccattggatcaactggtcttatacagctctgtggaactttctgttcaatctaaggattactctttgcaaaaagtacggatattactataaccttgcttcttatatcctgctcaggaaggactgccagaaaggaaaaagaagtatttagaattaatactataaaatccagtacgaaccgttttattaaaacctctcgaattgataaaatagccaacgataaaatcacaccaaacgataaagcagctgctgatccaaagggatcagacctggctgctggactgaaagacctgctttgttctatgaaaaacggaatcgacctgcagataactaaggaatttgatggttacggaatcacttccttcctggacagctttgaggagttcattaagttcagaaaccctaatattgaccctgctatgaaaaagaagcttcttcttttctatgttattgaggaagagaagcagagggttaaagttatccttgaaagttgggaccactggtctgaagtagtttaagcgctcaaacgataatactgcagctgtaaccccgagcagcttattcgacctgaagaaaagctgcgaaggctcaatgctatagtggttgcatttgatcaacagcagattactactttcatcaatactcatcggcttctttgccagaaaattaaccctgctgaatggagcactgatacgattcagtcccaatacttactcagggccctaccgtctgaccttatctttaatatcgcctataaggaaaagaagacatacaaagagctcgagagaatggaatataagaaactctgggcagtggttgataaagctgtatactaatacttcctgattataaaccgcaacttcgactatactggtaatagaattagtaacgagtttatagctcgggagtattacctcggcatcagcaggccaagaagcaaccaaccttctgggatacttggaggaattggagctgatggaattgatcaaatcgaccttatgaattacctgcgaaagcaaaagaagaaggaggaggaagtaaagtcctcgaaggtggagaagagggttggcttctaagaccttcaaagggaggctgcacagttggtgcagcagaagaaagaagaatcagaggtggaaaagataagactcaagttcgaagaaataagagtaagctaagtccaaatgcaagaaatgctcatatcccttgtcagcagtcttcgccttctcaaggaagagaatatgaagttgaatctggagagagatgggatcatgctcacttgctctgaaaggagtgaatgacagagaagcatttgattaaactcacaatatttctgttaataccgcctactcctcgcgagacccccaagggaactactggtactgtggtatccaagggtattatcctcaggactgttaggaactcaagatagatagctaagtgaacggttggtgctactataatagtaaagcataatccttgctacttagaaagaaaagggagcctgtgcctcctagaattattaccttcttccagcagcgatcatgtgtaaggtgcctcgcagtcttttaggtaaaacgatttcccaagtgtaaccctaacctccgagagattattaacaatttgatcaaacgggaatcatcacacatggggagataggttgagactcccgaagaagagaaggagatcacgtattatctgaataatataccaggttggggcctgttaatgcaggttgaccccgataagtacaggaaaatgaataccttatcaagatacactgtaccaggctctgtaatgtttccacatatgaattattccctttccttacagcgctagcgctcttaggtctgtattttattgtatggatagggagaagggagcctggatatagtaagagtggaggtgtaagcatcgtgttaataacctaaactaccaacccaaactactaaccagcaataaaaacaaggaaaataaaagtttctatagaatcagttacatttaattaacaggtaaaattatataggtggaactcgcttaagttgctgaaaacggaactctgactatataaaaatcatatatataatactcagtatcactataataattccaacagtggttaagctactaatagatatactatggacagctgtaggatatgagtaaattaattaaataaagctgatgcttggaagacaacaagcacttgagtacgacaagaattaggcaacttataggataggcgcaccacgacgaagagataacaaaccaagctatataccaataagaagctgaaaagaaaaatggagaaagcaacaacttttgaattttagcctgcataataacaacaggcctaatacggatgaataaaactaaaatatataggacttacgcagttctatttgatcaactcaacgaagcattctccctacagccctagtaccctaattttcttcagattcctctgtatcagccctatccctcctcgagcgaaagataggagcaggattctaatccataaagtcagcaatagtattatcataagtatatatatctggattgcctatgctatccttgccaacggggatattgattgctttaaaacccctggagggagtgcggagcttggaaggtgaacggacttgagtgatatcttgacgaggaaaagcaggacttgtaagagggcgccgatcagctacctgagaaccctgaggtagtacaaccggaggcaaaaccacaccctggacctgatcaattggccgagcaggcgactttgacatcatctcatcaatagacggtagcacggtagttggaagcttccaaggctggcgagataaagcctccgaaggaagtacaggcgggagttgacctgagaaaggctgtgtcaagcctggccgcgggagatcaaaaccctcgaaagaagagctggactccttaccgcgaaggtgaaaagaacgggcatccgacctccaatcaggaacaggatctgcgataccttcccaaggggtatcggaatcctccttttgaaaccctgtagaacgaaataaagtcccggcttaagaagcgaaatctgactcctgagactattaggactcctcgccagacaattgatcatatgtataaactgaaagaggtttgcttcccaagcctctcagcttgggtcgggcaacaggagttggggagacagatatctgcttgcgaagataagcaggactacccgccttaggggtgatagattgaggccttgaaggagagagatcggaagaaggcttttcttcctgatataaagaggtgataagggtgatatagctatccctggggattgggatcggtaatattcgcgacgaggagttaagaacacacgaggaatcagtggtggtgaggtctcaaggagcttctgctgaacccagctgcgataaggaactcgggtatctacgcccaaaaccagctcttcgacaaattgatcaagttgagattgggtagtataagtatctttataccagttaataggctacttattcgttactcgtggagctgtctgcagtcggagaggctcaggatagtaaacagccttagcaaactgtatatgccggccagtgaagagattccctacagtactctcttcgagcgtattacacgggcagtagtcaactcgctcatactcacagttcgtataagtataaaagagacagtttgcgtacttcccaccgaaggtatccaagagtgaataacagctaaagaacaagcttatgatatgaatcctgttctggttgatattactagcgaagtttcgctgataatacgagcatagagccgggttttgatatctatagagggcgatgataaaagctttgaattattacttgtttacgatcaggctgttaaggaatcgggaccgcgggtgtatataatcagctggtatatataccgaattgtaccgctgtacttgatcaattagattataagtatatataatagccttacccttatacattaccttgagaaggagtttgatattatagataaaaggtgtatgacttgagctgtaataatccctgcgataatacagctcagtatacactggattgccgttataatcaagggcattaccagtacagaaccagatatcgaaattcttatgaaaaataatgaacccagccgccttaattatctgattaaatggaactcgggccgtatgtgtaccccggtcgacaggatgagaaggtgtgaagttattaatactcatcggttagtatataagcgatcgaatatcgggcagcaaacgccgcgggagcccaccgggctggtctatcgatatcttgaacagttgatcaagtggattctggatgcaaaagaatcagaaaagagaacttgccaggctggttgataggaattacttacggaaaaggcctgataaaataaatcctgagagtacgggagtcagagaaagcctgcaatacgagtgaggaggaggaaaagaagtgaactcatattaaaaggcacagcggcgttttatacacgagttctttccacggacccaagaagagaaagtaacttgatcgaatgaaagataatacgagggcgtacagtgaagagggtaggtgttcaggaacgtacgaagctgaaagaagttgtaatgtaaaggagagaagttgaaaagaaagcggtgcgagaggtgacttggaggttgaaaggctgtgcgtatacaaacaacacgctccttcccgcacaacaacgcgtgcagataaaaatccaacactcccacccaactcctcctcttctccttttacacttctgcaaaaccatatcttccacttcttctgcatttgatcaactacctgctacattatgagtacccctaaagtcagtattatcgtggtagaactgccgcacagccctctagaaccttttagacactatgagtgtattactgaggcagaagtatcaaacggaacacctgcgacctgggaactcacccgtatcaagagggataacgagctcttctacgaaccgcgcacaaattgggagaacggtgccggccttcaaaatcaaacacttcccttggaagacatcgactcgactgaagaactcagaacgatcctgaacggtatcccggaaccgatgcccaattggtcaaatccatcgtggaacgatcgacccagccgacggttagctgcctgggaacaacaccttgtctacatcctcaactttacaaccaagactgcaagaagaaccatggacgattggcacgagtggtcggaactctctgcgatgcaagatgtcatgctgtacggcaaagagcatgttttcgggcgattgatccattgcttggtggtcgatacccaggaacgagagcccagttcagaagttttatactcggcaacaagaagctgcgggcgatttccaccggaaataccgatcgttggagggcagcacaacggaggatttacttccctcgaggactttcaaagggaatgcggcgggcgacgttttatcacgggtttcttctgcttcagagacaacaagcaccccttagggtatcactaggcctccttcacatttgataaaaaggaatgtgttcttgacttcatggacacttggtcaactggtcggcctcgtcggtttgggtatgcggtggcgagctttacagccttcaatctcaagatgaatctctgttcatccttcatcgctacctgctcccaaatcctatcgcaagggaacgcttactcttgcggtcttttatctaccttctgcttatggatgaaggttagatcgtggaagggggtagaggtcgcactgggagatatctccttgaggtacaagggtaaagtggacaagagtctgatcatgagccagataatgacccgactttcgcgtacgctgaggttcgtttcttggaacattttcagcagaagttcacttgatcaagtgagcggggttatgatgagcatcgcagcgaatgaactggggattgcaaacttgacgctggactttataccggtacagcccttctttggagataatatcagaagactatacggccgagagagcagaaacagctgctcgcgattagttgctataactggcctggggttactggctcctattatatctcctctagatggacctctggctagctatgcagatgtaggtacgcctagcctattgatcaattacccttcggcccgactcttcacagatcaccctcaggaagtctacctacctcgagttatccctgtggactggattaccgagtgggaaaagaagggagatggagattgctccaagatgactgctgcgaatacaatcagggttgtctcacttgcatctatctttgacgacaaacgcgctcttgatgacccgggttctgggatgaaacgggtggttaaagaccctattacacagatcaaccttacgagcggggatgaaggggctcctggaaccccgctggccaaagaccaagctctatataaatttaatattaatctaatatctatttatatatagttatttatattatataataaaatatatatatatactagttatagagtataaggaatatactattcctactaatctagctctattttataataggagtataatactctagttatttctattctttagactatagagtatatataactatataatctattataaagatctttatttataatataatattctctttttattagttttattcttaagattctatataattttaataagtttttcttttttctatatataataactatattataatatttattatatctaactatatttaaaagttagtatattctaagacttataaataagttcttcttactattattatttaaatatttagtttactagctaatatactatatactttatattttaaaataaaataaaagtattttattcttttaaatagaaaattatcttaatataataaatatacttaaaatagttattattataataggctattagttatatctaattataggtatttctatatattttcttcttctatttctctttctaactttttttctttttaatagaaaaattaataatataatagaaaaaactaattaaagaagaatctaatataaataaaaagattcttcttttattttttttatttttattttttttagctataagtaagattatcctaagattaggtataatatataatttatctattatatagggtttttttttatatatatagttagcagtctatacccagaccttctatagaataaagattaaataaatatacttttagcctgggtataggtattaatatcttaaaaactctaataataggagctatttatatagctagatatatataacccagctatagctataatctctaagaggggaagctttattatctattaataataactactcctctaaacttatcttaattaattaattatatcttatcttaattataattatctccttataagtacttattattaataactactataagtaataactataataataaaataaatataactaatatattaattcctactagagaaagctaagttaatataaataatctagccctttaaagaataataataattatcagttagtagctaagagagctatatcttaactatattaaatttttaagcctctaattaattagagagcttcttataataatacagctgtttatagtataatagatccagtagctatatctacttaggctatctctatactataatagctagctattagatactaataatatacttattaggaataagaattagctagattaagagctatagctatatcttactaataattatcctattatatatatatattctaacctaatatattatctttagttttagtatattatatactatattaagataatctatatagagatagctcttatttaattttatctattttattctattaattttaattagagtttagatttaaagttagtcaggcttagtattagataaggttttattactgggtaggaaaagtagttacctagaagttaatattaatttacctctgtaagtatagtatagatttactatagtaaagttcctaagatctatatagagataagttttaatcttatacctatttatctatatatagttctttttagggattcttcttttatattaataaataatttaattctagagtaatctttctattatcttaggatatatttagtatatttataaaatatatagatatattaaaagtaagatatagtaggagatttaatataatctctaagaacttaataagaaaaattaattattttctaattaggtttttaattttcttaaataatatattttaaaggaaatttaatttttagagattacttttaaaatagatttaaatttattagatcttaaaagggatttttctaatttaatttctctttttctttttaataaaactaataaattaaatattaatatctttttagatatttaatagatttctatatattatcttaattagtatattttatttaactaaataaaatatttatctatttctaatttctttctttaggattttttctaatttatatttttctttataagctttaattagataattttaatttagtatatcttttagtacttttttaaattcttgtgcttcatcgttctcgcatgagatcctcttaaaaagctcacacctctgaggggacgacctgatgaacttgacaacattgtggagttttcctaccggccctttctttctccaatgatgtaggtcatcctcgtatcggccgagaaggtcaaagacctgcgattcggcctcgaaagcctcgaaatcttcgccgtagagaaacgcacgagcaaccaggttcaagatatatctatagcagcgtatgcgtcgagcccgaatatccgccgagcccatttctgcgtcaaggtctccgtagaagttcacaaggcagttgtcgttcgaagatgcgttatctgagatcactgttccgactcgatcctctatcttccattcacgtataactcgcccaagcatcaccgccagattttccccgctgtgatacccgagctggcgtcgaagtgctagtagacgcgactggtgcttgcctacacggtcaagaaaatgagctgtaaccgccatgacagcgtgccgattgggtgaagtctataggtcgaaccccagatggattttgccaagggcatctgaaagctcctgcctgacctcatccttcttgcacctatacgtatcatcaagcagacggctcattgattgccggctccatgatatctggtcagataggtgagggtcaagtcgccaggcgagttgttgaaagaatgcatcgctaaagaaagaaaagggagcattggtattgagcagaagtcccaggctcagttctcggatcaccttgactctggcacgcggcacggtgctgtactgcaagcgccgtcgcttgggccggtcagattcctcagttgacgggtctgtatcggcaccttgactgctctcaaagatcctgtgagacctacatgtggttaataatgctcaagctcgcgacgtcgtattctcatacttgcggaggtggtcagttttcaagtttcagggtgaagatgaatggtaaagttcggcataaccgtcaaaaagcatgcaatcactgccgtggtatgaaggtaagaccttgctctagtctttttatttgcacatgcagagaagcaatgcagttaatatatttcatataggttaaatgcaatggcgagaggaaaggttgcgagcgataccgagctatggggaggaactgtcaataatagaacgcagctagatgaggatgctcaggcttaaatctcatgtttcaaggttgctccttcgttcctctagctaagtgaaataacaaaatgctttgaagaaccttgttaaagatgcgatttaatgaaagcagcagctctatagggtaaactagatgcgacgacgatgattaagatgtggctggtgcatgatcatgtggccagggactggtggctgaacgtcttgcaaattcagtatatgacgagccctgttcggtgttcattgtcttgaatgttggtgctaactatctcccttcctcagctcgaccaggcagttgtctgcatccccccagccagtagttaaatacatagcttatcgatacgatctaagtgtggagacgataagcaacagatccgtggtcgcggtttagggggacgggtagtttcgggcagctttgaatcacattctctccttttccgataatttcctttgttgccagatacttattgggctgtcttaaacactctttctagtagccaacaaaattaatgaaaactctttatcccgggagaaaaaatgagaccacggatccacgttattaatatattattaatatatttatagagtatttataactaagattctataagattataaagtttataaaaagctagcttttcttctttaataatagagattttataatcctactaattatatttaaatagattaattttaaaagttttcttaaatagtttattataaattctatattcttctagaatattctttagttattcttcttcttctaaatattttatctatatatatttatactagatattatttttcttattctattatactttttattaattatttatttagctctatttctagattctaatattaaatagttctaaaagtagtttttctattttcttttactattagctatatttaattttatatttttattattatttctattagtatactaaatacctccaactagcagttacagcctggaagcctattatagagcggtctgcttagttataactgctctagaactagctttataaccggcctaactctatagctaggatagtaacttaattaataacttttatacctatctatctataagtatatactttagaaaagccttctaatactgatcagtagttatatagtagctacagattagtaaagaagaagagataggatttcctaaacagctagttaaggatacccttaagattagctattagtcctatactatagaactatatataatatataatataataatactattatcttttatatactttaaacagttactttagagcttatttattcctctaataatactattagtactagaaatacttctaaagagtatcttattatatatatctccctattaatacagataggagcagttaataagactacttccttccttaactgctaaaccttaagagtttacctttataggatactctctctttcctaattctaaggagagataagaaatcccttatatctctcccttactgatactctaacccctctcctattagaatcctcctaaacggagatccttatccttctaataagggtagaaccctatatacccctgttataagatcccctatatactctagaccttatatcttaagtatatataatagtactactaatataaaccctacctatagtacctccctttaaatataataaagtagaagaggtttttaatataactaagctaataaaggcctatataaatagtattaactagataagctatctaaccttagtagtctagattactactgctatacttactaatatatatatagtatactatatatactgctataaatataccgagctatatagtagtaatctattagataagtttatatataacttcagaggctagttactggaaaagtttatacttctaaaccctaatattactaaggagctaaaatatatattatattatagtagtatatatactgaacccctgaataatatatctaaagcagcccttaataatatataagaactagaagacctactagaatagctaagaaatatatagttccttttaaatacctttaatccgaactcctaggtattctaattataagagtaatatagaaagttataaggatacagactactaatactataactactctaataaaggagtataacctatataattaagattaataagatagaaataccctaactaagtatagatataattctataagtatctctatctccctaaaatatagttctaaacctatagtataggggttatatatttaccttatataatctatattataacctcctactagataataatcttaaaataggtactatatctatataagaacttatagccttctagaagctctataacctgaaggagtacttatttaaaggagaactatataatatacttaatataaagattaggataatactaaatatatataaatcctataatatacagcctagtagatttaagattattctcttttaaatccttaaagggaatatataggacttctaattctaatatattaaagaagaatatatattcagagaagtatatcttaagctgaaatagtactttaataatactattaataagtagtagtattattataactggacccagactaatattactttaatataggtagatagagagaatagagatcttatagtatactagatactatagaaagtctttataacccttataagggtatagaagatacttaggggtaactataagggggataataaccttaaagatactatagtaagagtatataaaagctcgaaggagttagaaatagtactctaaagaaagtatataaatactaaagctcttatataaagccttatattagccttagagataagcctattaaaacagctagaataaagcttaataactctaagagcctaggatataataagagatatatactttattaactgggaatatagatatacttagaaactactaaacagaatataatagcagctttattactctctaaatataagagaaagactatttaatagaggttttactagctgaaactaaagactataatataatagctagagaaaatactattttatttataataagcctaggtattagttaataaactacctatagtaaagatataaagtatactattaatttataactgagttcctcgaagcagaagaaggagtagaagaaagtaatatactagaagaatttaaataataggtttaggacctggaaggggttaaggaccggtctgaaatagcagactatagagatcctgataactataataacctagataagaaagactagtatataagtaataataagtaataactaatataatacttacttaataaagtattttagtacttactctctagagaggagatctagggagaactataagatctattatactttattattaaagaaagatatataatatagttctaggggattatactagatataggtactttattaatcttaactataggtaaactatagtttaaagtactctaataaattaatctattaattaaactagatactatagctaatataaaaagtattaagtttagaaaaggacttatagagttactaggtataatagagctatatatcctgttcaggtttattatattttatataataaacttagaaacccctttcctaatatatctttataatatagactatctgaatattaagtttaagaatataactaataagatagttaggactatagatagcctctctgttctaactataaggaaatagagctatatatagttctttcctgaatatatactaatagctaatacagcctatttaatagaactagagctaagataactctactactactttagttatctattagtagaaaggctatactaactcttagagagagtagggtataaagatataaatagagaggtaataaaaaagattaaatacttctgctactaatactaagcctatagcccagctttaaaatactttaaattcaaattataaaataatcttaactttaactataagattataattaatattatatacttactggattaagaacctgtcttatatatagtatatatagtaactgtattttaaaatataaccttccttaagaatattttagcagatactatataggaagtattaaaaaggatctagctagatatctatctcgaactgccagactatattatatataatataggaacctaatttactagtaattaattttatataaatactaggattatagattctaagtataagtaaatcctaattaaaacctattagttaattagtaagattaaaagatattacagactattataatatatatttaatatcctatataaggaacttaaagggataatattaaaggaagctatattataagtagtagtaaaagcagttaataatacagtagagcctaatagccttatactaatattacttatatttagagtatatctaagagttactatctctccttctttataatctataattcaaagagtataaacagctaaccttataataaaagtattaagagaactatatactaaagagagaactatacttatactagctatatataatagtttaaatataatagaactccttaaactcctactcctaagtaagattatagtatagagagagaataaggagtagtttaagctatataagctattattaaataactcttataatattataatcaaaatatataatagactaaagaccttctagtctatatatataaagctatattatagggataaatagatagaaaacctagcctaagatagtattaacccggataaatacctaaaagaccccttgctacttataataaacaagctactatagagaagggggtaactaagaggcttaaagaataagctaaaagtatatatataatatatagtataaccggttagactatatactaactatataatatataaagagtaggaagctctcgagctagctaggaaactataaagagaaggagctattataactctgggtactccctttaaggcctctataaaagcagaaattaaataacttattaaggctggagtcttcgagtttatatacttcagccgagaggtttagaacagctagctatttaagatatatattattaataagataaagggctagaatataaaactatataagaagagctatttagttatataaggctataataactcaggtaaagagatagttcttatatagttactaactatttaatactatagctaataccttatccttatattagtactatccttaatatagataggaaactatattctaaccagtagagatattatatagatctacctatagtctaagataaatctgcaatatataatatatataagactatctgaattacttaaataaagctacccggagggaatagttataagaattataaagctactatatagaatagctgaattagatatatattagtatactatatactataagtactttataatatatataaagataataacctctagctataatctataccttctgattataggaagtaatatacttagcttcaggcttattaggatataaactgataatatactcagattatttaataaggtacttactatagaggaagaatactagttagcagaggctaagtttaaagcaaaagctagaatccagcttacagagggaactaatctggagtttaatagtagaaggatatccctctacagtataactattaagtttatatagaaaggctaagctaatatattataaatagctataagagatctaaatatagagagctataagtcctaaagagtataaggtatatagattataagtatagtataactagaggctttatataacctatctatagtagtatagatctaatagaacctattagaagaggatattaataagttaaataagagacttatatagtaaatagaatactataactacagccttaactttatactgcttaatctatataacttaaagctgtatatctttatagatagcttgcttataaataaccgggatataagcttatagattgggtttattattatactcagtatagaaactaaggtagaaagctaggaatctatatttaaactagttaggaatatcctatactagtcctctataaagtataaatatattatataaagcagccttatatcagaagtctatagtatagtagctagctttaatattagtattataattataagtatactccggataattactttaaaactgttattactagaaataccccttataatctgtatagatttactcttactatataaatatcttattaaactggggataatagtagagaaaaggcttataattaatataatagccttatattaattatataaatattataaaattatagaaataaggtagatctatagagataataaccctgctaatatattaataaaagttaaatctaatatagtactcttaaaacttatagaattaaataaattaagggttagggtataagggaatattaaaaaactatctaaaacaggtaaagcctagtaaactaaacagggaaattaaactagtataataactgcttagggatataattttaaatatattataagtaagtagaatatataaggggggggcccctaaccagggtaattctattccctatttatatatctatctaagctatctgttttttttatattttttatttttatatttttttatatttttctaaagttactaatataaactagacttatataaaggggttagacttattactacttataggagctgaagagagtaaagaggaattacccttattacccttagtatctataggataagataattttaacttataagccttagtcttaggagctaagatagggtactgcttaaggatctatttaatagagtccgagataataggcttactaccctctttatacttaataatagttaaactattaaaactactattataaataaggttataaactaacttctatactgtacttatatagttaacccttagacaggctatagtatacttagctattttaagtttccctattatagatagaagcctagaaagaacctcctgagtaatagctaggttctgagctaagggtattaatataaggggtatagtaatacagatattactacccttattataataaatatactatcccctatttctattatagttatagtagcagctattactcttcctcgaggtaagtaatttaatatatatagtatacttattagtatatttactagtaagaatagttagcttagaaagtagaaaataaacagattactaatacttatacctggttagagtataccttctctatataagtcttcttcctcttagccttaactaactccttccttatacttataagtatatctatataccgcttagtagtagtagataggtaagtaactactttaaaacttattagataagtatacctaatagaggtatagggctgaacttactcttattaatagtcttattaaccggaggtaagggggtataagggggagcggatatagctaactgatttctctgaaataaggttagctataaaactttatcttaaagtatatggatctctatatacagtataattaggaaaagaaataataactattctatatatagttagctatagaactatattctaaaacagtaaggattattatagggatatatatataatagaatataactatatagaagaaaggaaaaagagaaatacttagtattttaaaatagggattattatagatagggtatatatctataattacttattattaggataactaattaaactataatagtagggtaacctaataataaagtatatatactagtataataagcttatattatagtatatatatatataattaaatagtataatacttaaggaatacctttttaataaaggtataaggaattagaattatatatatttattttctatatttatagaggttataaaaggacttataatagaagaagctatctatatagaataagaaaaataaaagactgcctgtattagtatactaaatacctctaactagtagttatagcctggaagcctattacagagcagtccgcttagttacaactgctctagaactggttttataactagcctaactctgtagctaggatagtaactcaattaataacttttacacctatctatctataagtatatactttagaaaagccttctaataatttctttattaattattcctaattaattagtactaagaatatatctaagggttattcttatttctatatctaatttaagatctatattatttatcttagttattattataataagttttttatagttctagattataatactattaaaactataactattatatctacttattattataagttattactattttttataatagtatttttaagtattaaaaagtaaatatatttttctagtatctaataaaattttaattttctttaattctaatttagatatttaaaagaatattattattctatatagctagtatattaattaattagtagatttatattttataactatagtaattctaatataatattatagctttttaatagtattaagttatatattttctattagttttactataaataaagatatattctaagattaggtaatatataatctaatatatattttttaaaaatataattagtagtttatatctaaacttttaatattataaaataaaattaaatattatacttttaatctaaatatagatattaatatcttaaaaactctaataataggagctatttatatagctagatatatataaataatctagctataactatagctcctaaaagggaaagcttattatttaatagtaataactatttttcctttctaacttaaagtactaattacttaattaattaattattaaatatctagtaagtatttatagttataatatctaatataaatattctaatctcttagagcttagttaatacttctaataagacttttaaagtaataataattattatttaaagtaatctaatatagctatttactaattatatttattatatattcttctaattagttaagagcctacttataataataaagctatttttaatattatagatctagtagctatatctgcttaatctattactttattatatagtctacttagtattactataaatacttatagagaataaaaactaattagaagaaaagctatatcttaagaataactatttacttatataagtctactataatctaatatataatttatagttttagtatattatatactatattaagttaattaaagtaaaaataacttttaaaaattaattatttaagctttatattatttttagttatatttagatcagagtattagttttattagcttagatttagtattagtatattagagtttattttaatttaatttaaaattatatttatttagaaataaaaaaagttagttatataaaattattagttaatttatttctataaatataatatatatttactattatagaaagtttttattagaaataatatagatttaatattaatctaatatctatttatatatagttatttatactatataatatattttattagataaaaaatactcttttaatagttattaatataattatctatatctctattattactagctttataatatttatattttctattagttttattataaataaaaatatattctaagattaaataatatataatttaatatattttttttacccctcttacgagctatagctacagctgggttatttatatatatctagctgtataaatagctcctattattagagtttttaaggtattaatacctatacccaggctaaaagtataatatttaactttatcttatagtattaaaggtttaggtatagattactaattatattcttaaaaaatatatattagattatatattacctaatcttaggatatacctttatttatagtaaaactaatagaaaaaaaaatttttttttaagaatataattaatagtttatatttaaacttttaatactataaaataaaattaaaatattatacttttaatttaaatataaatattaatattttaaaaactctaataataaaaggtatttatatagctaaatatataaataatctagctatagttataactcctaagaaagaaaacttattatctaatagtaataattattttttctttttaatttaaaatattaattacttaattaattaattactagatatctagtaagtatttataattataattcttaatataaatattctaattattatatagtataaataactatatataaataagtattaaattaatattaaatctatttttttttagaggtttttactatatataaggggtaatatcctaagatcaggctatatataatataatctatataattagtttttaactaagttctaatctatatctaatctttaactttatttttttttactttttattatatagctagctaagatatagataatagtaactctaaaaactctaagaagagcttattaaatatataacttagctataagctctaaaggggaatacttattatctataattaactataatatctctctaagtttattattactaactacctctccttataactacttattactaactacctcttataataataataataaatacctctaatataattattccctatagctagagtttagttattttaaataactagatctttatatatataataatagttattagtaataactattagaatctctttttagatattaattatttaagcttatactctattatagacttacttataataataaaactactctcttatatatagacctagtagttatacctattagaattattattctatcttatagctagtaagggtatagagatagacttaatctttaataatatacttatagagaattataataatatttctctagtacttaataattattataatctaaggtactatatatagtatcagcaggtaatatactagcttaagttaatctaggctaaggtagctctttaaattaaataaatatttattttagttagtattattaggtagaagagaattaaatagaatagaattattagaaagtttattagatagaaaattaaattaaataaaattaatttaatagtatttagaattataataggttagttagttattactatagaatctttaagagaaaagtaatagctaattataaaaattactatatactattttcaaaactaagtctggaattatatattaatattaaatctatattatttctaataaaaaccttctataatagtaaatatatattatatttatagaaataaattaattaataattttatataattaacttttcttatttctaaataaatataattttaaattaaattaaaataagttttaatatattaatactaaatctaatctaataaaactaatattctaatttaaatataattaaaaataatataaagtttaaacacccaccaaaaaccagagcaaggagagaactatccgctatagagaggtatatgataatactattgctggacacaaggagaccattgttcagtatcctgccaataagggtctatggtatataattcgatgcgaggaacacggacttaaatttggaggtagcaatccactcatggatgccgcatttcacttgggcagtctccagcacgataaatactcaaaagcctataaggatgttatcgatcagatgggcatacgagtcaagtactgtacggcgagccgtgcagagcaaaacaataacgagttcatgaaagaagctgttcagaagaactcactaacgtcgatggatcggaccacaggtagcaaagacgaagacaaaaggggcggacaggcttttggaagccgaaaggcagccttgatgagcgacaaagccgaaacatctcggagtagtcaggacacagaagatcacgtctacgacgacagagggtctaaaacgtcaaaatacgacgatactaatgaaggcaacgaaagattgtatgtacgtcgtcaacctggcgacatatgcctcgtctatcttgggggagagtatatcccaattctcatccttccttttgacaatatgcttgaaattggaatcaatggcgacctcaagacgctgaatctggtccagcttatgcctgactgctgtatctatgacctgaccacgggaaaatacaggtggaaaaagggatatgaggatggtggagcgttcgaatcgtctcgagcgcaccctggtctatgcttaactcacaacaccctggagacgtgtcctccagtgtgggtaaaaggaacaaaccacccaccaaaaaccagagcaaggagagaactatccgctatagagaggtatatgataatactattgctggacacaaggagaccattgttcagtatcctgccaataagggtctatggtatataattcgatgcgaggaacacggacttaaatttggaggtagcaatccactcatggatgccgcatttcacttgggcagtctccagcacgataaatactcaaaagcctataaggatgttatcgatcagatgggcatacgagtcaagtactgtacggcgagccgtgcagagcaaaacaataacgagttcatgaaagaagctgttcagaagaactcactaacgtcgatggatcggaccacaggtagcaaagacgaagacaaaaggggcggacaggcttttggaagccgaaaggcagccttgatgagcgacaaagccgaaacatctcggagtagtcaggacacagaagatcacgtctacgacgacagagggtctaaaacgtcaaaatacgacgatactaatgaaggcaacgaaagattgtatgtacgtcgtcaacctggcgacatatgcctcgtctatcttgggggagagtatatcccagttctcgtccttccttttgacaatatgcttgaaattggaatcaatggcgacctcaagacgctgaatctggtccagtttatgcctgactgctgtatctatgacctggccacgggaaaatacaggtggaaaaagggatatgaggatggtggagcgttcgaatcatctcgagcgcaccctggtctatgcttaactcacaacaccctggagacgtgtcctccagtgtgggtaaaaggaacaaacctgggaaattttgatctgatggaccctgttatcatgaagcaggagtattaccagccattattgcgcctcatacagcaggccgatgtgaacagatcaaccatcttggcgaatgttgtaacagagccaggcagccgacgtcccagcagctcgggaaatatcagagatggaactgacaccgaaatttgcgcgaatcctagagctgatggcaaagacactgaacccgataacatatccaagcaagggggtgaagtcgaagaaagaccagacgatggcctctatagccaaacagatcgaggagagaatcaagacgatgccctaacttcggatgctggaaacatccaaaacaatgtcttttcgggaacaagtggcatgagttcgcctagtatacgtcaagatgggaatcgattaagtgagcttcaagaaggaattgaggcgagcatggatcgctcccccggaccgtccgaatggcatattccaagtcaacaatcgacgtccaaacatacaccagcactttctgacgatagaacaatccaaggttcgtccctaaacggcgctactacagtcccgactggggcgaccgcctgtgaatcaaacttgagccatgcggaatctggagatgcaccgacagtaatgccctcaatcgggaaaagaagccagagtccaccacccatcatcatcatgagagcagtctcaatccagaccatctcatccgattcaagtgatgagggcgagcagctggtgaaagatgtatcccacggcagtccgggggcattggcaagagatacgatgggcgtcaacagcgatggacctggaaatcctttagagaaccaagctgcgtctgatgaacttggcctagggcgactttcaaccaatgcagaaagatggcctattcctacttcctcgactccaggcaaaacccctgggagccaaaacgtatccacagcaaggggagtccctcatcagcaagaaatggagctgtgctatacagttcctgaaacctcatatgttggaagccagtatcccaggcatgcagtgggaaatgtagaggggccacagcagcgttctaatggttcttggccatctattcgaccgggaaaggcgatgacggctcctaagaatagctcagcaaccacagctcagacacagttcatagacttaacaacctcaccggtcgggagctcattccccacgctcgccaccagcagccaaatctcccacacgcaaagccaccaggtcggcaagcttcatgtctatggaaccatgccccaagaaatgacaagccatcccccaacaaggcccagtaacaatcgagggcgtcaactccagggccaggttccatctcaagcacggtttgaaacaccgacattttgcaccccgcaagctggacacagttttcatcaggcccagatgcaatatcagccgcaggctggatcttattctcagccccgaccggagatacagcacccatctcttaatgaaggtggtgcgaatgtggatggagaaaaaagtgttcggttgaggggggtgttcggttgaccagggtagcaacttaacagcgagtcatttaattaccccatcactttgcgacaattatcctacctaccctatatattaacgatgccccaacagtcgttcattgttcccagtctccatttcaatgcttatgatcttggagaaagagggcggaatacaggataaaagcttggtgacaaaatgactgtagaactggatcaaaggctgctgacccatttgttgaaaacgacgtgctggttgcgatgcttgtgcccttagtttgtgattgatataatggaaccgtgttgtttgccgatcttgaggaggcaatccaaattgtggaagaagctacagaggtaatacagaagggatgccaggataattcagagtttttaatttctctcgattctctatacgcgtgaaatcttccattgttgggcttatggcgcattgcgaagagaacatctctcggagcgggactacccctgttgatccaaccacagcgacttcagaacacgctaagataagctactcaaagttgatagataagataagaagagacctactacttctttaactcttttattttcttaattaactagaagaaggtaacttcctatattattaccttcttaaactattatatcttaaataataattattaaattttgtaggttattttctggagaaaagagaagaaagggtatattttagggaagaggtatcagacgctagcagggtatttattaggctggctgaaccaaacaggggttaaaatgtattcaaaacaataaccctgactcacgccaccagattacacaggaagggcattggaatctcgcggtctggactttctataatgggacagaaacatgatttagaagaggctataaagcccgataagtatactctacaagagccttacttaggagaaaggtatcgaatttaagcttgtcaacagtctgtttgaatactgggacagctattaagtttgagtctcgtataaatactatggggcttaccttacttgtactgcatctttccatttattaaaccatgacctctgaaggattagtaacaaggctgtcagtagcattatagtcgttggccgtgattaagtatttatattatacgaatgtctgtgtttataatgagcggtagccagactacagacgaacatgttagaagtggactagttttcttctgctccagatgcaagacaataaagcttctcagtatgtaagagacaagcaactaccggcctggctaaccatccgatatatagcattcaatttaacacgaagctagatcaccaacgcattgacgttcaatctcccggcggcccacggcgccaatgcatctacgtggctgactgcattgccaataccttgcgctggttggctagaagatgagtttttcaattgtagtagggtaatcgaccgtggtatagcaatttttaactagtagttgctgaaattagctcaacaacgatcatcacatgatttaacaataccggctgttggacatcccttaggtcacgtcgattgattgaaagtagatatcagctggaattcacgccttgagagggaataacccttggaacgcttatgaacaacagcgatgagtccatcacctctactgcttccacagctgttggtctatgattcgagtgcctgtatcgtttggtcaagtttggtgttggcttaagccttattgtcacgacttttgttcctactggcgtctcagactcgcttaattatacttatttagttagttataagttataaatcatattatattgctgtcaaggcaaaggacgtctatctatatgtctagtatataaagagagggtataataatagaaataaaatattgatctaggtttctcaggggctacggtgcgcgtgatatcaccgccgtggtatacggagtttgcggaatttattcctgcgcaggagttggccaaaaagaccatgaatttataaatgatactaccaggtgaccaatattcggtaacaatgagctgcagatcatttccttgcatagctgatttgttgtctcgagataggggcaaacgatcgttggtgtttcgcctgccccgttttcggccatattagccgtaaagttgatttcggcgagctagggtagagatttatctacccccgatattgatcttgaaactttgggttattcccttatctggaaatatgttgggcgaggggtcagtttaatgaccaataagagcctattaaggtcgtgggtaaccacggccaatttggccgtatatacaaatccacactgctcaggatggaaccctccaatgttataactatatcgatacacaagggtaggagttactacctggatgaaaaatacctatatattactattatacatatgagttggatattatttattctaagtctatatataaaaaatcatagattattacgacagctatactcggttaaacacgactacatttggctaagaatgaaggtttccaatagttcactggctctttgcctccttgcaacagcaagctgctctgcctcgataaaccctgaatacgactacgttgttatcggatcaggcgccggaggaggaccactagcgtaagctacagatccttcatactgctaagcactttggctaatatcacctagagcaaacttggcaaggcatggatactcggtgcttctccttgaagctggaggtgaccatgtcaacagctcactgacgacaattccagtcatgtatgtgcgaagtcgaatacaaataagaacaagctgactctaaatgaagggcaaacatagcagccgaggacccagagatatcgtggcagttctttgtcaaccactactctgatcctgacgaggctcagaaagactccaagttcatatggcaattgactaatgggtcatacttcgcggggtccaacccgcctccggatgccaaagcacgcggaatactgtaccccagaggtgctacggttggtgggagcgcaatggttaatgccgctgggctggcgcttcccccggataacgactggaaccatatcgcgaatctcacgggagacaactcttggaaatcggagaacatgagacaatactttgaacgtctggagagcaaccactttctccccaaagatacgccgggccatggtttttctggttggcttggtgtaagtgttattccgctccaacgagtctttagttccttggctcgagcaactttcttccttctaagccagcttctgtctgtgccgttatactaacaacaagcagtcgaatcgaaacaatctttccatcgttcgtcctgatgacggttttttccaggtggttagcacggcaatgactgcacttggggactcgtataaccccagcaaggacgaagttttgaagctgttgcatcgcgatagcaacagtcctgacgggaaccgctttgaaaagaaccgcattacggaacatactctgcaccatgaccagaagcatcgtcgctcgagccctggagcttacctcaaaagcacaatcgacgaaacttactccaacggcacacagaaatacccattaactgtcagtacaaactcgcttgccaccaaggtgttgttcaataattccacaggcccaaagtccgttgttggcgtcgagtatctcaagggggctgctctctacaaggctgattcacgctccaacgaagccgacagcgggagtgccatggtcgcggttgcaaagagagaggtcattgtggcaggaggggcttttaatactccgcagattttgaagctgagcgggatcggtccccaggcagaattggaggaatttggcatcccagtccaagttcctctcccggccgtgggtacaaatctgcaagacaactacgaaattggcgtcgagggactggcatccaaggactttttcaacacctttgagaactgcactaccgcctttgcgcctggggatccttgcttcgacgagttcatggagaccggcaccgggccgtacacccagggcccgatgctgagcctgctgatgcgctctagccaaagcgagaatgctgatgccgatctatggttctttggcggcgccaatggtgtgttccgcggcttctggcccggctggtcgaacgcgacagcccctgtaagcaacttttggtggtctattgtcaaaatgcagatgcagaaccaagcaggcacagttaccttgcggtcggccgatccccgtgatgtgcctgaaatcaatttcaactatttccctgaggggcgcgactccgacctggccgcgttggttgaaggaatggagctcgctctcgatatatttggcaaggtcgaagcgccgtgggctccattcaatgttacaagacctatccagtcattggaggaagaagcaaagtacgagtcctgggggcatcatgcatcgtgtagctgccccatgggtgtcgatcaggacacgagctgtgtggattcccatttcagggtacacggtgttaaaaacctcagggtcgtcgacggctcagtcttcccacgtgttccaggagggttcccggttgcggccacctttatgattagcgagaaagctacggatatcatactggaggatgctaggaagttggtaaagtaagatgtatagaaggagaattgggcaaactgttcacgtttgagagccctagtagtagttgaaagagtattattaacttagtcaatgagggatcaacgtacggaaaagatggcctgagcagttagcccgcccctctttagacgagaaaatcaccttgctcaatcaaacccttgttgttattgttgttggctttgcgatgtgccaggaggccgtggaacataaacgtttattgactgttcaacgcacgactgacaaagggcctaggaacttgggaacatctgaatattcactgtcctttgttccacaacgtccaaaggcgccgtatgtgttatgatgaactgacatcgcgagtcaaggggaggtgtagatagttacacgatttgctcagttccgtctctgaactgtgcgtgcgtttgttagttgatgatgcgaagtgttcgaaatatatgattggctacccttcgtctttaatgcggaacgctcaagctaagtttaatgaacatacgatgtagaacaaggtaatggctagcaaacaaataatagtgcgcacatcgtaactccgaggtcgtctctcagctaatcacgggcgctggaacccattgcctccgtgatccccctcgcaaatctgctgtcccacatctctcggaagacccgcgggctaggcaaacgaactacctatatctgagctgccgttaaagatgtataactaacctctccgcatataatattgaccaaataattctccaagtatgaaatcatcaaatgtctacaagaaaaggtccattgcgacttgtcaccgtcaacacggcgcccgagcgtgcaaagcgcctcatcggacgcttgatcactaagctgcaggatgactatgagattattcatgtggataattgttcgagtgagtttatcaactgtgcagcatgggcgcgcgattgattaatttaggcatggatgaggttgttccaaaagtgacagagcacaagccgaatgtatggtgagtgtacatgactcagaaagcttatattacaactagaactttccttctcagttttcggcttctatgtggtccgctgaggaggtggaacaaattcagtcgttggcaaggtctattgtgcctgatattaagcttcatgctattccgacgggactgcaggttgagacgggaccggatgctattattgagcaccttgttgagaaggtccctcctctactggatagctacatcagccaagataggaagttcaggcaaatatcatcaaatattttagataccagatagcttctggtagatacttgatctataccctaataagaccctcttgaacgatgagacagtgattgatagaggcaaaggtgagccacctgttcagaggcggctttccatagacattcgacgattcaatactcgacattgagaatttaccgccagattgggatatgaggctaaagggtccagacattactcctccaagaagccatcgtggtccagtattagcacgcaagaagtagggttcgccgggccagcaagttggttctcggactccagccactcgccaacccctgggggctggtggtcacgcttgaaatgaacatcgaatccgtcctcggccgccatcatcttctgcatgagcattgacttgatgtcacgatcatctgtctccggcacaaggatgccattgtacgtgtcgccgacatatctgaagaagtcagcccagtcacctggtgctaccagaccatcggtctcagtgtgaggtccaagtaagaggggattgtgtgtaacatgctgataacctattagctcatgatacagcacaattttacgtggaggtagaacttataggagggatataagcaaagtcgccaggccccatgattcgacacgtatcaccactccataacttcaagaaacccttggtgactagaaagatatcatgagtctcctcataccagttaaaaccaggagcgtccgctaaaacagcaccactggcaaatacagctatgccgccattggtctgcttcgacgaagcaaagattgtgaaaatacccttgctgccaggaactactaatgcgctctccttcgagccggtcgatcatatagcttgtcctcttattgggaggagatatatacaaagagacgcttatagtgaattagggatagcgtaaattgtgatggtgttggtgagtacgcggagaaaactaccaagtattgatagattggtgagcttggccggcaggaccctctactcttctactcctctgagctcccacttcccgatctccacatcatgatatggaggcgctggagaatccccgcatcatccccggatttcccgtctctacccctgaaataacttcggccgctgacgaagctcagcttggaggtccggaaaagccgcaattccgacacggggtcgacggcatcaccggaacgttgatttacagcagcatatcagaaccgaggggtagtaggatctttttacagatactcttaatagacactagatttttgttcacgcgttattgagtcatcgtgttcttaggatcatagtagcagaaaatacgtccaccaacttcgttccgtgctgtttacaagcagctaggtgaacaagagattaacgttgatatttgcctgccttctatcgggactgattctacaaaatgtccagtccgtaagttaaaacatcttatcatctctgtatccatgctaattgcctttaagtaattaacgttcatggaggggcttttatactcgggtcctccaaaatgatcaacaatgaccaggtatcagtttgtctaagtagagagggtggatcgtcttggcaccaaaccatcgcctttgccgggagggtccaatgcaagactgccgtgatctcatggcttgggtttacgatagaggtcttgaaatagcgttgcgcaacgctagctcaacactcgtaccagactttgatcacgcccttgcgtttggcacctcttctggtgggcatttgtcactttgtctagtaagtcaacttattcaaggtatgaattatatctgatccgatttctagggctttagagttccgcaactagttgcagggacttacgatatgtgtggacctagcaactttgctgataacttgtggacgataaagctggagggcatgaagctaccacctggacttacagactcatttctcaacaaaatctttgacgaggacccagtccctattactagaggcgtctctcgagagagccaggcaacaggaactccagactttagcgacccccgccaagcatatgccgctgatgcaaatagctaacagtactgtccttgatactatcttcccttcaaaagcctggacaaaagttgaccctgtattgaatgttgactccttgtttcctccaaactttatagtccatggttctgcagatacaaaagtcccgatccatcttaatagaaaactgtttgatgtactgaagtagaatggtgttgagtgtgggatagtggaggttcatagggaggagcatacttttgcggtcaggatggaagtgggatcggttatttggaatcttcagcgacagggttttgactttcttgagtctttgattaagtagttatgatgatgttactctttaaaaagtgcacggcactggctagcttgttgtttaatagttagaacttatactatatcaacaaaaatacaagcctaacatgttgacaagtcccgattagctaaattgttcaaatggaaatatgtaaaacacctaaataaagatatattctgtaacaaaaagggttatttaatattgatgatagtttaaaagtatatgcaaatggcaaagttatgtactgctaataggaagacatgtactgctaatagaaagatacgtactaaataatctatatagctttggtaagctattccgtaaaaggatcacgcttcactgcatcttcaacaacctcaaacgcatcatacccataaagccagggctgaacttgcgggcaagtccacctgcttgggaacgggcctttaagttcctcaacgccgagctgagacaggaaaatctgatcgcgggcctcttgagctggtccatcaggcatatgaaatgattcccgctacaaaagaacaaaagattagtgatgtctttcacacttcctggctcataggtactaacctggttaaaggtttctctcacgatagcttctccacgggattttcgcagcctttcgtacatggataaggcttttggtagttggtgcttcgacttgacatggccgagaagtaggccgagaactgctccgtcctccacggcggagttggcaccttgggctaggtaggggagcatcggatgacaggcatcaccactggaggcaatatgtgaacaggatgtctcgcaaagcggcgaaataaacaactacttacacaaagacgagatttgaatcagcgttgatccatgaatcaagctcttctcctgcaaaatctgtcagctccgaggatacgaacatcaaggtgtaacttactgtgcatcagcttccacttgacaactttgtcaacctggctgagaaatcttgccaggattggatcccaatcgttgaacaactctcgcatctcctccaccgagccagcctgtcgactaacgtccgatggaagatcgtcgggggtaagaaggacaatattatacatctgtccgccacgcatagaatatccaacagcatgagcacccggaccgatccagaaatgcaccgtcgggcgctcaacccattctcgcagctcagggtcgtcgatatccttcacatccagaacaacgcggtatgctagatccccagtgggcatgggcttgtcctcactcccaagaaacttggaacggcactttgaccagagaccgtccgctgcaacgatcaagtcaccggtgtacttggccccagcctcggttctcacctcggaaatgctaaagtcaatgtcctttactctatccccgagcttaaactggacacctagttccttcgccttatcgtatagcgctagctggaggtctacacgatggagatcgataaacggggcgccgtacttcttgcggatatgcttatggaagtcggcttctatggcgagcgttcgtccggagtatcgatggacgacgagtgacgtgggttcagcggccgattgccagagtctgtcggggagatcccatttttggaggatgcgtgtgcagttgggggttacttgtagaccagcaccgacctaaagatatcagtctttgtcttggtagtagtgtgtgattgaagagttatatacctcgagtagctcttttgccgactctaaaacggtgatattgtgtcctgaaagagaaatggagatcgctgcagcaagacccgcaaggccagcgccgacaatgaccacctgcaaacgagtatcatctttggccggactaggttgctgtcgaaatggactattagttaagtctaacacgttagatagctgtaacttacagtgcaatttggcattttgatacagatataattgtcaactataggtttcgtgatgaaaaagaagtagaagagcatgcagctgccacaatactacatttataataaaactaacactccgaacgtgatggatatagggtagtcgagagctccctcggaacagccgaggttacattgctcacgcccggcttttccgcagctcaagatctcagaagctagctatgttcggtttagacagaaaccttcccaaccaatggaaacctctaatatagggttctctaatcgaaatctccggccatctggggactccgcacttgtatctcgaagccttcctcgttctagggtccccaagtttgaaagcctgtgtacattctctcgacctagtgctactgatactcttgacatggatgaatcaacagattcccaggtgactagacctgcaacgcagcgcccaaggcggccaagagccgcccgcgcgtgcgatctctgtcgttccaagaaatacaagtgcgatgaatcttatccctgttcatattgccaaagtcagtatctagatctcaaatgtctgcacgcaatataatgctgactgtttgaaggccgcaatgtcgaatgcgtgtacaaaggccaggacatgtcgcgcatgcgcatgacatcaaggtatatctgcctgcagtattctcagttctgctcttggcttactagtgcaactgtagctatgtaagacaattggaagagcaggtcaagagcctttctagcattgtggagacctatgagaaggcagcgaccgatgggccaagtcacagtcccgaagggatagcgatgaatgcctcatcgttaccaatagctcaggatccaacggtaatggaggcttttcctacaccgaatagcatctcttcatggcatacgagagaacaagaggtctctggcatgaatactcacacgagagatgtcgaattctacggtagctcttcatccgttgctcttctgtctcatgtccggcgaactggggaggaggacaacggtgaagatgacgtgggtgcacttctctcctccttgcacaaccctcacttcggcccaagcggatcgcaagatactcagcgaggcaggaggagtactgaagagtcggatcactcaccatggtacctccaatgtcggaactttatagacggtttcttctccgcgatccactacattcacccgatcttggacaagacttcgtttgtgcaacgctgtgagtctttgtgggcgggtgaagggccggagaataagagaatcacgagttttgttgctttgtactatagcatcttatccatcggcgcattggttgggccgagggaggacgagctcatcgacggaataacgaatctggcctggagccggaagttctttgaccgagctagagattgttgcaataggcttggtatggtcactgatcttgatatggtccaatgctattttatcctggtaggttgtgtcgtgaacactcagctgaacgacactgatgaccacaggccaaagtctgtcagaacgaactgcacccacatcgtaagtcaactgtgagcatgcttatgatcgagatgtactaacttctcttagagtcatacatgtatgttggccttgctataagaacagctttggcaatgggtataaaccgtgagccgggacccaatagtaagaagcccgcgtctttactaagagcagagacacggacctggtggtatgtcaaaacattctttgagttggaaatagtatggatcgattgctaactgtcttcaacaggggactttactctttagaaacgtgagtatctctcgacctgcagttatttcgttgtcgccgatctaacactgttgaagtgaaatgtctttcgccatgggtagaccagacactttaggagcagatctatatcataatcgacgatttccgcgtatcggtaacggtcagaacgagaccgagacggattctgagatgactgaacatccttgttgcgccataatcgagcatatggtgcatttctccaagatcacaagaaacatctgcctcagtatctacctgcccgaaacgacaataccaatgatggtggcgatggctggccagatcgagcgggacctggaggcgtggacacagaagcttcctgaggctatacggccaatggggtcatcaactcaggtaccgtctttgagaggggtcagggatgttcaatgggtgaaacgacagagactggtgctgaacctgcgttcgtgtactacgatgcgctacagaaaatactatgctaatgatgttttaggatgtcataacctgagaatactcctcttcggatccttcctcttgaggtcaacggcacaggagagggcgactatgagtgatactaaaaccggcatccaaaagtgccttgaatcagcaaaggaaacgatcgaaaccatctatcagacctaccagcacagcgactacttccgaacatggtatgtatcatcacttcaaagaatgcgattgcactaacaatacaaaggttctacaacacgacatatactgttttcgccgcgagtatcatactattgtacatgacccaagaggcagtcgagagcgaaatgcaaccactacttcgactagtcgatatggcgatcgaaattctcatgatcatggatgagtgcgttgttgcgctacaagcggcaaagctactacaaggagcgcgggaaaaggctacacagaaatcaccaccccaagccgtgtcagctgcaaatccagggaattcttggcctgatggaatagtgcacctgaatcactactgggggccactgaatctgcttgatggggatttggatcagagcctcgatatgtcgttgataaactttaatgcagcgagcctgtttatgtcgatgcctcattagttcaatacaaatactataaccaatcaagtgttggacagaacgtagaaagcagtgaggcagctttcattgctgttaaactttatactcaaaaactcttaggtagaaagcagtggacggtgacggtatatatagctataggagcgagcagaagtagagcaaaatttgtaacagctgatatcggattatatggtctagcaacgaatgaggtgcgtcttattgctcacgtcgggctttcacagctccttgacgagggcttccacagctccttgacgagggcttcaatctgcgaagggaagttcggcaagaagtaaaagatggtgctgctgtagatggggccctgcttgaacgtcctcatgtcgaagctcgtgatgatgcgaggttgttgctggctcccttcagagcggtccacaggtcggcgttttcattggcatggacattaacaatctcgccagaggcgagggcgaaatcgtagttgatgatgttgtcgacgataagaccctctctacttgaagaaggacaggccgcctgctctctacgatagcctacacgcaaagtcggacaggaccggggcgggtaatcataatcattagcgacaagtctccgatgctacatacagcggatcgtccaccggcgactgcgaggccgtgagggtcagctccgcgtacacggcaccctagtgctcgccggcagcaatcttgatgacgccgtgcttgacatcgatgccctgagcagatcaaggtccagtatgatgccgtcctaggcggacccgggcaggggctggagccctacgctacggacggcgaaaacgaacgtgctcacgaaaggcatgatggtcttgaggaagcctgcggcgtcttccttggaccgggtctggacgatcctcgcgggttcgaggtcgctctcgaggcctgacagataggagatgttgagcttgatgaactcctcggtgcctcgctcgacagacttggtatctgcgatgacatagcttggctgacagtcatgatgctcaatcagagacgggctagtgtgaatttgttatagccaacttggtcctcttacacatctcgtcaaagctctggcttaagtacgactattaaaaagtctggcatatgacatggcataacgcgctacgtgggaaagatgcgggacatttgagggccgtcgtgcataacaacagccgccgtcagagtatcgtctctggagggagcagggcttacatcttgcatacagcgtctccaactcggcagataccgcagaacaatgcttatctactgccccaaatgcagcccgtgagctcagttggcacactcttttgactcgcgcaatcgacgtcgtatgtcccctggttgttgtatcagactcccggccccggtccttatcactcagtcatgtcacattcgcgttttgactttctgcctgcctgtggggcaagagagactatggcaagctgcgagaccagttaggctccatgttgcgaacaataggtaggctgccaaggtttcactggccgttggcacatggctgatgtgtgtaagacctcacgcacaattgcaactgtaagatgctgccgtttctctcgcattgcagacatgataataggcactgttgttaatgcaacgcccatgtagctgtatcccgcggccgctatggcgctccaatttccacttcctatatgactgtctgttgggccatttctcacaatgacagacatctgcctcaaccccttccttccatttggtctttttatcttttttttttcacccattcattcattgatcctttcttatctctgagcagcgtgcgccattcattatggcgaaattcatgaatgctgagttggagcgtcctctggcaccaccgtcagagccacctatctccccagagcccacggtcgacctgattatagagctatctaccgcccagcccaagaccaagggccactcaccgcggttctgggccatcatagtcagcctgagcctgctcgccttcatctccgccctcgacaccgtgatcatcactacgaccctgccgaccattacccaggacattggcggggccagcaacatggcaaaaattatttcgaaatgataaactcgactctgtattgcaactcccttataatgcaatgttcacgtactacatagcatcccctacagagtcgaaggcaattgatgctcagccctcagaggtgtagcttaagtccaaaactgtgtaacaggctcaccatggttataattgtggctctaagtctttggtcagttgtgattgacctttgctaccgtacactagggagggtcctatctgaatgactcttaacagctttgacctaatacagaattccacaaaacattcgtttcaccaaacctctcgtcctaggttgtgtacagtctgacttcatgctccatctgctcgccctgagcaagtagcttcttattctctttcttaagtaagaccttcatcagcatggatgccgcgatgctgagagccgagaatgccatcatcagtaacatggccatgacgtatcgcggcccatcagaagtagggaagaagtagggactccagatattgccgagctgagaaagcaagttgataattgctgttgcgcaggctcgcttctctggtgtctcattgagtgatgatgccgcccacgagtatacagcggcgttggcggcaaatgccccagaacagtagaggaaagaggctgtgtaacgagccgcgttgttcagagtcgcagccgagatgatgaagcctatgattgccacgaacatcgggacgctgatatggtagccacgttcgttgaagcggtcgctcgagtaagccacaaggaatgacacaatcgcaccgcagaggtatggtggagccgtcaagactagcgtgatagttcgggacccgaggtgcatagaactgacaatactatcatggatatgggattagtgactatacgcactgttccattcgcaaaatactcacgttggaaagaagttgttgaagccataagcagtatggttcgaacatagaatgatcatctgtttcggccagtcaggacaggaactatataggtatttggctcccggaaattactcacgaatatccaagttcgaatgtcctgtacagcaagtgccagaccatgccatactgtcctttcggttttaggtagggaaacacggtcaagagctatgcgctgtcttgccagatgccgctcgttgtcgctaaagagccatcttccactaccagtctcggattcaggaaagtctgggagaaggacaaaagcgaagagggctgccaagacgctaccagcaccttcaaggatgaacaaccattgccagccatgcaggccggctttgtcagataaaccagcaaagataccggccgcgatgagcccagaaaaggctgtagctagaacaaggcctgagtacaaaaccgcagttcggagagcaagttcctttcgggtataccatgcagaaagcatgaaaaaggcctggagccaagcatatttgagtcagccttttccgagtcgtaaaatgtggctcatgagtaggatggcatagcttaccccagggaagaatggtgcttcgactattccgagaaagaagcggacggccataagaccagagaaactagtaacaccagctgtagctgctgatacgcacgaccagaccacgacgcaggctggtaggtagatgctcggccggactctggtaaggattatatttgagggcaattgtgcaagcatgtaaccgacgtttaggatcgatactgcaacattgaactcattgccaacgagtccagtgtcctcttcgagtttgtcaagacgcgcttgtctgtgatgcgctgcaagttagcggatagccaacaaatatgggatatgaatagatcgtgagacgtgcgcaatgttgtttctgtccaagtagttgaacatgtagagaacccagacaatgggcagaagtgttgtgtcaagcttgcggacaatccgcttctcagcagccctccactctggactctcatggtggccgaaagagctttctgtcaactgcatatcgtgaccttcgttcttggagaccgtctcggcgtggaatgagacactgtcttcattctcagctttgggcgagactgcgtgtgacttctctgtagtcatatttgcatctgatgaaaaagagactcctgggttgagaaataaatgttaggtagtccgtggcttcatcacctccagaggatggctttggtagattattatagttatcttgactattggtgaatgctactaggtctcgcagggaagccgatcgccctcaccgagtcggcggctcagaatgtggggaccccagactttgctcacccacaaaagacggggaacaaacaagccatgggcagaagcatatgcgtttggtggtaaggtgaacggtttgccgagggagtgcctagtctagctgttaggattagcgtgtttgctttatcttattaatctaaatttaaaaattaagatctattacttctttctccttagcttaccttctattcttttctcttaagatctctagtatagatatttagctctagttaatacttaagagaatacttaaaataatactattattaggaggtaatcttatatattctaaatccagatttatttaattatataattatataattctactatattaagaatttatcttaatatctttctataatcctactatctaattaaacttaaaagtagctatattaatattatctaataaaatagtcttagatagcttaattagctactttatacctttttctttagctaaaagagagaaagctaagttagtaaaaatctaacttaaagactagtatatcttattactattaagaacctttatatatttaaataatctatttctctttatctattaggctaaaataatagattagagtattttaaaagcttttctattagtaataaagatattcttatatatacttattttactttattaaaaggtatagggtttattatacctactattcctcttaataatctattagttaggaataagctttaagataactattctatatagaatactctatctaatattatcttatagagagattagattaataatctattctattttagggaaaataaagaaatagaaatatttactcctaataataggaactattattctattctctttcttagtaattttaatagtaaaatttataagattaagtttattaataactactactaaaagtatattataaacttcctactttaagtaattatttaatccctagagtttctattatagaattagtattttattaactatttctatttttttctacttaattatatatttagatcccttaataataagttataacttctttagtaagaacttatactaacttctaactattatttaaagggaaaataagtaaaaaggtttatataagttactatctctttaattaaacctcggccccaagatggagccaagtcgcatccgctcaggatgcgagtcaaagaccaccccgtcaacaccaactggcaggtgagagccaagacagaaacaaagtagacgaacaacggagagcagagaactggaagccgtaccagcacccagtcggagctgcaggggaaacgaacagaataaggtttttatcctatatataaggttttcccttattaaagatcagatagagggactagagactagctagacctagcacctagggtaaataatataatatatctctttaattaaatagttctactttactatagtaaaatttatataatatatttacccttataaatatagctaagaggcttattataatagctttatatctagttttttttctattaatctaactatctatataataagttatactaatcttcttattaaagaggaaactagtttaataatagtcttttctatttatcttaaaatagataaatcctataataaactattaatctttaatctttttttagaatttcttaatattttaaaatccttcttagtaatttcccttaattaatatctagcttttattaaagtaattatatttagctattatataataaaatatagagattatattcttagctaagttaatttctaaagtagatttaaatctagtaaaataacttttctttttatatagtataatatctaatattatattaagctttattctatttaactactacttttagtatattataataataaagttatagatataaattaaatattatttataggctatagtttttcttattagttttaataactagttcttattagtttaaagacttttctctttagggatttctatcttagtattaagcttataaatatatttaatatatttattaattaatatcttatttattataactagctagtatttataagattaatagaaagtagagttattctttctaattataggaattataactatagtattcttagagtatattttctccttaattaaaaactactttctaaagttaagtattatctctttatagtagtagaactttattactcttatttaattaaataaagttttaaagaataagagtttaaagctagaatataaaagataagattaataatatatagatagtagataaatatagatagataaagcctaagtttttaagatataataaaaaaagtaatttataagatagtttatatatagattaagagtaaaatataaaagtataagaagataaaaagaagtttagaaggttatagagtagaagtatttatatttatagataaatctaggagtaattattatatataattactctaagtaatacttcttaatataataattttcctatatctttctcctttaaaaattagattatataggtaatttagtatatttttaaatagttcttttctctttctttatactatatctttttatttttctttttttttcccctttaactaatatatagctttttaagcttagttagctatacttacttattttcttagtttcttagtcttttgttgaatttgagagattatagccactataagttagtgggttcagattgctgttagcgatcacaaccactagcctctagcgattgcagccactggccacaatcgctaataaccccctgctaacgctagccaatagcgattgagatcgctatctgatagcgattacgatcactaaccaatagcggctgcagccactgtgggtcagtggctacagcccgctatnnncgctacggcttagcgtgccctaggaaccctcaggggtccgggccaccagcagagctattattaggttatcgggcttatctagcccagataagggattgaagaaggaccgtcacgcacctcgacatgttcatgggtcgacactcgcttattatacaccctcaaatgtcctctaggcaatgatatacactcgtaagcgatgaaaccagctcatagcagctagtcatggtgacacagccatggagattggcaacatgacagggagtataggcattcacccctctggctctggtttccgtacctcgctccttacacgctccctgcccgggtggagttcactttgttttcctgggtcagcctagagcatcagtttaaatagagtctgacgtcccgaccatggtcgttcgctcccactcaatctgtttctcaccaatgccccgtttctagcctttagaaatcgacccttcactactatctaccnnnnnnnnnnnnnnnnnnnnnnnnnnnnnnnnnnnnnnnnncgaagaacagctgcgagccatgatgtcttccagtgagcgaaaggggagcagcacagagaccgttcgtgaagaatcgctcgattattcaccgaggagtcccgaagataaggagactagcgtagacgtggcttatgaagaattgcgtaggactcatcaaaatacagccaaataacggtcaattgaagccgagtaaaatacacaagatggacgctgctcttgactatcataaggaaaatccgggaatttctctccgccgtgtggcgaaattattcggggttgcaagggcaacgttgcaagaccgcgtcaagacaccgcgcaagcgcaaagaggataaaaattgcggcaggctacttacagctgttgaagaaaaggctctttgcaactatattgatcgccttgatagtattaatatggctgtacgaggtgaattcgtatgtgatgcagctaatgcgattatccgggcgcggcatcgccctgatgatataacaccaatccacatcgtcaagcctcgctgggcaactcgcttctttcaacgccacggatactcatctaggcctcaaaaaatgcttgacttggtgcgtaaggaagcagagaatattgaggttattcaggattactttcagcagcttcaggaggttataaaccgcgagggaattctccctgacgatacctggaatatggatgagaccggcttccgaattggcatgaagtcaaatgcgatgattataacgaagaggaaaagggcgcattattttgctcttccagagaatagagagtcagcaacagctgtagaagctatctctgcaagcggccgggttattcctgcgttccttatcctctcatccctcacacattgtgctaattggtatcacgagcttcagggtcttgatccggaagccagagttgctgtagctgagaccggctattcgaatgacgaattagccctcagatttagtttaaatcaagcaatctgaactggagcgagtgagtgctgatatgtgggtcatgcctactcgcataaactaaccaatcgtgattgaaacctatagcgaggatcgttgcattcccctcatgactagttatatattataattatatttgacttagttaccgtagcctggcaggtatagctagctataggagcctactattaaactactgactagtaggcgatatgaggatttggtaagaatcagatgaagcagaattactattatgaagcaattaacgcgccgcttagggtatacagctggtcgttgtccaaactagagaggtaatagtcaagcctcgagtaaggtataagactgctaatgctcagggcttcggaagtttcaaatccttgtcagggcgagaaaatgtgggcctttctcgcattgtggatgaaccaataattattctgttgatattggatacgagcggatcctagcaaacccactaattcaaactcgcttttgggagcatctccatccactaaactctccctgtctccactaccgtaactgtcaacctccgcgcattgagccgctcgggccatcatttccggccagaaccgtagacgtgtaaatattattgctctcttacatcagggctagtcagttcgaaaccaccacgaatgcgctcgtaaaacttagccaataggtagatttttctaacctcgccaccattcgctccgtttattcagctgtaacgtactacactgaaaatatcttagtctctaaaaatgaatgtttagccaagttaaaagggtgggcgatatgaactcttacttacagcaccaaactgaagctcatggaatttacctcagtctacgtctcaaaaagacattaaataatgatctgttatgtataataaatgcaataaaatttaaccttagctaaaaatccgattacattttctttcaaatatatctgaatccgagctggtccgctagtactatagcgaacttccctgctgcgttatagcggtctcaaggcccaatacaccttgaaggccactgtaatttcaacaatacttattatatactgaaataaaaacagaactggaatttctccaggaaagaataaaaaaacactataataaaacaagattaaagggactaatcttaaaggagggagataaggtctatctacttcgtaaaaatattataataataaggctaagcgataaattggattataaaaaacttagactatttaaaatcttaaagaaaaaatcagatactaactacgaactttcactactagatataatatatatccacccagttttttatatcttattacttaaaaaagtactagaaaacactccagactaagactacccgatcgaggtctataaagaagaatataaaccagaaaagatcctaaagaaagaagtcagaaacaggtaaatattttatttaataaaatagaaaggctataataaaaacaataatatataggaaccagtcaagcacctgaagaagtactaatatttaattcagcagttccaccagcaacatcgggaaagaaagaaggatcggaaaaatcaggaaggattaaagtccaatcaataatccctacggtactaagggactgcgctgtaccgacagcctgctgttcctccaagatcgcctcctcctgagtacgaatactatcctgttcgtccaaatcatacaccctacaacgaaacaaacactgggatttctcccgagctacctgacgctagcaacgaaggcgagataccttcgctaaagcctcctggagagctagctcagataaagctaattcattctctaaataccgctctttagcaactgaatattttactatatacaaaatcagtaggaaccagaaaaaataagaaataaaaattacatatactataataccacctcgatactattacaagatcaacccagctttacacacttactgcagcgggaggaagcttcaattatataatataccttcttatacttaaaacaatttaagcaagatatagttttaatacctatctctttaatcagggatacaagatacttacgctattacaacttcttggataaagactacaatataatcagcgatatataaaataattaaaagacgaagaaaatacatactagctattggctgcgaaaactggtcttaaggataaaaccaacagggagggagcaatatattacgaacaaagtatatacctactatattatatagtataccctaccttttctactaataagggatagattactccggattatcagtaagcctaaatgatcctcagccaaacttactctggatcaccagtaagctattatgagcccctagtatatatatatatttatttcgctagatagaaatactccttcagacagttatcaatacaatcgtctacatatctattgttactagcttcacaatactcacatattaacagtaactcgcattgtacagcctacaacaacctgatcacaccactcagaacaacactctgattggttcaaccccaacttaccctagacccctgtccagtataagttacccaactgtcacaataccttatcttctaagctgaaggaattattcaagatctaagacctagtctagggtaggctggctatagggtagcctgggtataggttagatcgtctgagaatatcctaggatttttccgggttttctagacccttatctgggcttgataagcctgataacctattaatagctctgcttatactcctagccctacaggggttactggagcccgctaagccgtagcagttatagcgagctgtggctactgacccacagtggctgcaaccgctattggctagtgatcgtaggggattattagcgattgtggccagtggctgtaatcgctagaggctagtggttgcaaccgctagcagctagtggttaagatcgctaacagcgatctgaccccactaacttatagtggctataatctctcaaattcaacagctagtataaactaaataatactagttaagttcagaatactattttagaaaataagtaatatattttataggaatatccttagtactagcctacatatataaaattagatttagtactaaatagaaagtaacttttactaacccagaatattatctctactataggagtagtattcttatagagatcctcttgtaatactaaacgagttaaagatatccagtattccagtcaatattctattagtatagcctctgaatacctttatagagcgggtattaataatatatactcttataccgtattatactatctataatactgctataagattttattcaaaataataagaaaataaaccgatagataaacgtgttttgcgcgaaatggatttacccgaatagcccggcatgcgatatggctttttttttttttttttttttgagagagggaaccactttgaatgtacgatacagaattcgacaacgtaaaaactcgagaaattgaaaaaataccgtggagtcgtggcttgcaggaacccggatggatagcaacagcactaaactatctcgaggtggccgatctctttgaaattgaaggtataatatcctagaccgttaggctcaacaccgttatatagggagccgacgtttgaagtcgcatgctacttactagacagggggccgtctggtggcgtaacaccagctgttcccttggtcgatgactacaacgatgccgaacaaaccgccttacccttccagggtcagaatcgcataagcatacccatccgaagcttgttcctctcaaatagcctatcatatgagaataaggtggcgcacccccatcataccaaaatatcacatcatcactgaatagaatccagagaaattatatgtccgccatcttaattaaactctatgcaggtttaattaccccatacttcgcgctttgatcctattcgcaagaaaatcatcaacagcttgcatccctgcctcagctccacttccagctaaattccgagggaataagatgtagccatgcggcacacctggtataatactaaggaccgactcgccacctgccgccagccacctcgaattcatgaacaaagtatcatccaagagacagtcctcagttccgcatgtgaagtgggccgagggcagccttcccctcaactgctctaggtccgcatagagagggctgacatgtggatccttgagcatctccagcgaccatccaggcaggaatgcgtcacggaactcattcatcttaccttggtcaagaacgagagcaggctttctactcccataagtgtatacactcggcatccaatccaagctatagcatccaaaatgtagcataaggcctctgaggcggaattctgagaattcagacttattgtgttgtagcaaatggagaactaccagcattgacaagtgcgcgcctgcggattccccaccaatgaatcccagcggggcattgaaggtggtatccgcgttggatatcagccactctgccgcgtcgaagcaatcctgaggccctgcggggaacggatgctctggtgcgagccggtagccgatggagatacaaagtaggccgtgatcgttggctatagcctgtagcctgggatcttggtacgtttcgtcctgcaatacccagccaccaccatggatgtgaatgaaaacggcgctcacaggtttgctgttttgcggtctgaggatacggcatggaacgaagcgacctgagtcgcgggaaggtattttaaacgcggttgcggaggggaggagggttggaccaggaagctccgttttgccggcagcgcgcaggcgccgatactcggtagctccaatttccttccacctgggagctctcagagtgagttcaagaaggtcttgattgaacgccctagactcggaagggattgctgaaggatcgaagcattctggacgcaacatgcgaagatcaaatggagacatttttactaggacgaagcttgacgctagtagacggatgcctattctcgcaatcctatttatacttcgtaatgcaaaaaagcccttgagaacactcgattgtcattcgacgacatcttccgttgaaaagtggcacagctggtccagggatcgcaatccgaccaatgagatggtttcctccttcatgtatcatcggatccgatccctgatttgtttgaggccaactgagctgttctgccccccagcacaactttgtcaggggtcattctcttgctgaagacgttgcattttatgaaattgagatttggcattgagtatgtgcctctagaaggaaccaatatagacgtgagggcaaccggtaatgccggctgtgcagacatgtgatagtttcttgcaaagatattgcgacggtatatggtggaactgttagcttgtgctacggtcgagaaacttccaaaaaaaaaaaacctttgtatttataaaccatcctaaaactcaccgggggctttggccgtgcaattagtgaggaaaattgcttcacataagtaaaatcgatgtattggctacgttgttgagtcgttggggattttaattgtcctttctcttctaactaaggaagctttccaagtacaaggaacgccgttttctggcgcccacgatcgagtgtctgggtaccagtagagcgaaccctgcggagcagagttgactaactcagtcgacgcaagtcgttggccttgaaggagcgtgaggaaacccccgtttctagctttgataaaccactaccccgtgtaaccactcgtgatctggtttacttgattgaccagagcctgcacttgaacgcctaaaatatagtacatatcagcgttaaagtccttcaaaagcaataaaacaaatcaacgcacctcccttctggtcagcattcgatccataccagccgacccagtcaaaacaagcattagggttatttaggataagtccaccccaaactggatgaaccgagtagtccgtcttggcttgcggataatgaatgataatgttgtttgtatctggagtggaattgccttagtcaaaggacgaagcggctaaatagagaagtaatctggtcttacctgcccatttgttgtagccactattattgatgaacttggctccaatctggccgtaactctgcgcgcatccatggagagccacgtgcagtttgcatacactggaaccaccctgacaagcctgtgggacatagatatatccagtgctgtccattccagaggcgccgtaagtgcctgtctgggagaaagacaaaagcgcaccagagagttgtccgttatttcggggtactagatcaccgtacatccacttcaagactgcgcctgcaccatcatacccgcaattactgatataaggagatcgagtttctccacaagcattattgccggacccatcaaaatctgtaggaaaaacgtgagcagctccaacggtcgtgacgaatgagaccctggaggaatcatcaaaattggccaactgtgccttgagctgattcataggcttgggtcctacggttctgtcagccgatccgacctgcatatagatctggcgactctggaggttggcgagaggatcaatttggttcccgctccacgattgcatattagccacgggctttgtgatggatgggttctggttgttcatgcagctgctatactgtatcacacagaaccattaacatgaacgcagtgcacacaagtgctaagcacatctgacatcttaccagttggttgcgcgcgcaatcatatgggccaccagcaaaaatgccaaatcctgtcttgaaagtatcggagtaggcaacgcccagctgtgccgccatgaaccctccggcggagagtccagacaccgacacgctgttggggtcgacgttgtaggcgccgagcccagctgccagcgtaccagatacaagaagtctagctaggcctgccattacaatgaggctcggcatgatgagaaagatcaaaatactaaaatatcggtttggaaggctgtgggagaggattcctttggaagtgagaaatttttacgatggtagagacctcgggtttcattgcgggagggagggtcttgggctatatatcttattctcgagatatcacaccgtcggttagtgaggaccaaggcgtacctagacatatcccggttccgatgaggagatatttgtgactatcctagaaggcgcaaatccgcgcttcaaattcaatggaaatcaaatcctccccctctgaggtagtgattccacctatcgcgggattgagctgcatcagagtctatgcgaaagctgaccacgtgaatgtcgcaaacatgcggggtgatctgtggagtgaacctggggagtgagtttgcggggtagacctgactggctgcaggtgtgtggttgcattgagctccaggggccattcatgtcgtgttcagctcccagaatggccatacatgcaaggtggttgtttttaggatggctatccatggatgggtgcttgttccgaaccaacatagacgaaccggatccgatttctgtctctcggagcctaaagcccatgttggtcgcaacagtgctcacttgaatacgaacgtaactatgcgcatacggacaactcttcggttccgattcgtaccagtacctaacagtaatgtaagcgccagggatctgaagttctcagtatcttaaacgggcgcgatagtgacagctgttttcagaaggcgacgacggggaaaggagacgtttataacttcatgatctgtcgcctctttcattcccttcacctcagaccaccaccatcaacatctctctcattaatcaaatttcaccaccctgatatcttagcattcttccagcatgtctgagaaggcgacgccacatagtgcatccggcaaagatgccttcggacagcaagtcgaggtcgcaaccccctgcaatattggaactaccgaggctgcctatattgcgtgcattgaagccttgagtcccgaggagcaaaagagaactattcgtcgcattgatatccgcctggtttcgacacttggatttctctactccatctcccttatggacagaaacaacaccggaattgcaatgatagcgggaatgagcacagatttggtcatgacaggaagtcgctactctgtcgttgtgcttttgttcttcattccctacgtgctcttccagccaccatcgaccgccatccttcgcaaagtcgaaccgcgccttttcctgtcgctcacaacgcttgtatggggcttgacgacgatcgcaagtggctttgttaagaactggaatgagctcatcccccttagacttattcttggagcttgtgaggctggattcttcccaggtgagtccatatcaataaagaaacatgtcaaactgttggagacgctgaacgatgccaggctgtgcatacatccttagttgttggtatcccagatatgatctgcagaaacgaaatgccgccttttatctcattgggacaaccatatccgcattctcaggtatactcgcgctcggtttctcgcagctggatggctatggcagtggtccgacctggtggggacgagtccgagttgatagccacgctggtgacgcgagtatagggagcgggatatcgggatggaggtggatttttatacttcagggtgtgctaacttgtatcgtagctggcgttgcctactttaccgttctgggcttccctgacgccatgagcaatgttttgggcctcaaactgagcaaaagagaggcagactttatcttggcaagaatcgaactggataggaaggacactaccgctgaacggtacaaattcttctggctccctaaacttggctttgttgctgacttggaactcacagcttttctcttcgcgagtatatcgcaaatgcttacgacctcaagatatggggcttcgctgcactctttggtctcaccaccgtcaacacctacgctattgcgtactttcttcctttgattttgaaggatggcctaggattcagtgtggctgtgtctcagtgccttattgcgcctccctacattgcagcaggagtagctatgtatacaatggcgcacctgagcgacaaatatcgagttcgttctccatttatcgtgttcaacggctgcctgcttcttattggtatgaatctccgactcttgtaatacctgcctcgtgccagggctaactcaattctgaaggtttgcccctcctgggctttgctaccaatgtgggcgctcgatactttggtgctttcattaccaccgcggcttgcaacgctaatgttcccagcatcttgacttggcaagccaacaatattcgtggccaatggaagagagctttttgctcagcaactctagttggaacaggcggtatcggaggtatcattggtagcactgttttccgtagccaggatgcaccaggctatcgaccgggaatctacgccgctatgacggctagtggtatgatcattctaatcaccctagcgctggattttaagttcgtcagagcgaacaagcgcgctacggctggtggtaaggttattggagggttagaaggatttcgatatacgatgtaatgaagtgaggttgggacatcctcttaaccctaatttgattgcctggatacatgctatgccattgccatatcgagcaccctaactcatcctttagagcggaacacgggatatagaagtcgaagagccttttccttgatcacaaagctggactttactcctgatacatgtttacgttcttgcttcaaataatgcactttcctagcgtatttctgcagccagtctcgatcaactaggctagatgaagcgccagaatccgacacaatgacaatatctcctgatgcgagagaatctagttgagcaatgacctgttatttcaaggaatgttgctcagggacggactatccaaatcatggtattagttccgatctccgagaggtaccattgatgtgtctcatctcgataactagctaggtagtttcgagggcagcttggagcttagagggctgatcatcagctaagtggacaccattccacctctatgaccactaaaacttattggcccacgttagcaaatgtggacaagctctgaagatcaccatcaataaggaaaactgtgtgcaactatgaagatagaaagacaccaggaagcatcgtaagctcataccatgtaggccagacgccgtccctgtgttcccgctccgattagcgcaatggaaaagtttctgggatttactggctgctgcatcatgtagaggaacaatcgagttgaaatcaagatactaagtgggaggattacaatctgcgctcatgcttatcgaaacatgaaatacctatagaatgggaaagacttgagatttcactatttacactatatcatagtcgtcctcggatccgctcatccatttctcaggagcgtccaactgtcatttggggcggggctttcttcctgtgccgatgtgagtgccatcaggtccgatagctaagtgcagtctcaattcagtcgcctaatttcttcgtcgggcatggtttgatccagcttatacaagcctcaaaggttgagccaaagcaattgctccatgttgatacattcgacttgtatcaataattataatgcacttaattttcaatcccgaaatcgctccattcgccatgcagatgcaagggtaactcctcccagtacggaagttgtattccctctaggatctcatctagcgttgccgaggaaaatatttgtcgagctgcttgaacggacttggaggtctgggggagatgtttcaaagtagactccaaagttgagaataagctatcgtatgactcctgtgtgatctttttatttctaaaatcccggtcgatggctttgcgcatgagttgcacacccgcaacaacatgatgcggataagggtcaatggcgatgagggaaacagtaaacatcatatagcgtttcgtctcgctttcatgggttaggtcgggtgaaggagaatcaatgggtcttctcaaggtaatggtattatgaagaccaatcgccagtgcattcatgacagtattctctgcttcaatgccagcctcttcgagatcgtcgagtaagtcgtaccgagctacgacttctatcatatccaacaccatcaatatgctcaggttatagtgaagcatgagagagactatcaatagttagctaaaagaaattggtataccagtcgaaacatacttacaccaacgaagctttgtttgctggccaaggaaatgcatgcgcttgtagcattcatcaagaaaaggacgaaaggtggtatcaaattccttaatggaattgctgacagcggagacagccttttgaacctcggactcatcgtggccatctctgaggacttccttgaaaaccgcagccagtttccaacccaacagcttccagcaagcggcggccgcgataatctcattggctctttggtctgtcatctcaccactaccaaggcgccaaccttttgaagattcattgaacacattcaagcaggttcgcactagtctccatgtaaattcggactcaaaaccaaagagcccggatgagaggagtgacctgcaactgagtgtgagagatgctgatgtgtcgaatgtgattgctgcccagtaggcaatattttcggcattaatgaagctagaagtggtagcagactctagagtggtgcataccgaagtcgagatcaacgacagggatacctttgagccattgaattgaagatttctttgccgggctcgaagagactggacctgttgtaaagccgcgtggacgcaagtctggccagagataccatctgtctcctcgtcttccgagatacctatcggaattggagttagggaaaagagaaaaagggacaacatcgatcgatacgaggggcgattgatgattctcagcatatctcttcgagcctgtcgccacatagtctgcatttcgttcgggttactgaggtcgactgagccatctggagaggtgattggtaaccatcttgtggcaaacgcagcaatcgcgttgcgcagggatcgttcaatcaagacatcccgttccttgccttgcagactcccctgttcccgggccgggctttggttccctttagacgaattggccatatatctatcgaggtaacgacatagatctgatatactgatgtaccgttcggcgaggtcgtcttgtccaaatctattgcggtgagcttagataatccgggaacaaccgcgcttgtgctgtggacttacaagaaagggcagctatatcggcccatccaagagccgaaaacgacctcgaagttttgtctgtatagggtctgaagccattcaaagtgagagtcactcagtggatgtatctcagagtctgagagggcggatagtggcaccagaggagcttcttccaaaggctcatgccctgagtcttgcgtaggcatgagttggttttgctgaagatcatggctgcggatgttgatgcgagtctccgccagggtaactgcagtgattgactcctcggtggatgcttgatcagttagatgatgagaggttcgcccacaccgacctcgtgttcctgacggagttgcatgtgtattagaagctcccgccttggcatcctggatccactgtatatgatgatcagattccacctcaagaacttgatcttgatcttaccttgaatgtgcaggctcgattccgatttaggcaacgggtacagggaccagatagctcagaaacaacattacgacggctctgtgcatcgcaagcgactcgtgaccggcgacactcatcacaactcgaaaattgggtacgacgggtaacgaggcggtccggcataatctgaaactgagtcgaagtgggcttacggaagcaactgagagatactacagcaccacagcgtgatacttagggatcggatccgtctggagattgatgggatctaggatttactcgtgtgggctatattggggttacttgtattataaaaagggagaagttaaatgctctgttcttcacccagcctatgggcactctgaagtgcggggtaactgatcctaattatagaaaaaaaatggagaagatctggatatttgagcagggaagaagatgactatctagctgtggcgttttaccattagttttccgcatgaccactggggacggaaacctgccgtcagtgaagtgaaagctagggcaataaaagatgtccatggtagtgtcatattgaattttgttacatatgccctctctcgcctagattacctcctcaggacgaatggactatcaaaaaggtcgcagcatcgcaatgcaacgtaactggaacccgaccctctcctgaccaatcgctgcaaagactgagttgtccacgaataacctattttgaacacatcggatccgatgatcgctgccgtcaccgacctttaagctcagatcaccatcacactccagacaacccccccttcaggacgtgaagggggacggcgaggaattgacaagtatcttatagtcaagagcatcctgattcatgtggtagattaactggtagctgcatggatggtctactggctttatcgatcagtactgtattgtttatctgtaacttggcccataaggcaattagctctaagctatggattcaacggtagttgagcatgtgttgactactttgtccgtgcatattgaacggttctgacactgaataacgcccctctacaaattatgtttccacgtagctaagtgtcatgctggtcaggtataccactcgtatcctgtcccatgctcgcatagaatgcattgctaagtagcgagacatatacccagttttgccctaagagccctcgcctcgcccccccacaggaagtaacaacccaggccacgaggctggcggggagaactgaggggtaagtgtggtaaataaagactctgggtggctataaaaagtccgaccttcttccttgtcatatattatggacagcacatctcattcatacgtccatgtatcctagtcttcagtcggctcgtatagattcctcccagattcctcccagattcctctccatcgaagttcactgcgacaatgcctcccaatacgatgcgcgcggtagtcttcaacggtccatacaaggtaatacagtgttaatctctctcgtaaacgcctcaaataaatcgttaatactcgcatcggccgcgcacaggttcaggtcgaagatcgaccttacccaaagatcaaaaaacccaccgacgccgtgctgaaggtgacttctactgcactctgtgtaagtattcagcattttggttcaatatctgcgagcattaatactaacctgcctggccagggttcagacctgcatttctatcgtggccatctgaaatgccccactggttcatctgcgggcatgagtttgttggggagattgtagagaaaggagacaaggttgagggcttcgatattggcgacaaggtcgtcgttccgttctgttctgcctgccaggaatgctattactgcgtgcgcggccaggcgagccgatgcgccaagggtgagctattcgacaactcagcgccagccaatacgatcgatggagagcaagccgaatatgtccgggttcctctcgcttcaacgacacttgttaagactcccgacggtgagatttggccatgactggagtttaatgcacgaacgagatacgctaactggtttcttcccgaaggggttcctaaagaattgctcgtcctcatggcgaacatcttcccaactggctactttgccgctgctcggttcctgaaggatctgacaccgcgggaccgagaggattacacgacaattgtcattggatgccggcccgtagaaatctgtgcaattacttctgcactcaccatggtcaagaccgtgtacgctattgattcggtgcccgaacgactgactgaagcggaagcaatcggtgccattccgatcagcttggatgacagccctgtggagaagatcaaggcagcaacagaaggtcgtggagcggatgtgatcatggaaattgtgggccacgccgatgcattcatgctagcgtttgatctcatcagaccctaacaataatcccctgcattatctggcaaccgatgaatttcatctggtaggaaataaaaaggcgctagtataatataggtaactaataaactaatcttaggataactaataaactctagtctatccctaattaataatagaataaatataaagcctaataagataatagattttaatactaagattattatatagtattttttatctatagaaatagttttaaatatactaaattatctaaactagctatagattttaattctaatagtttttagctagtctttagctaataggggtagtctatataatatatctaatgaggagatatagtagttatatttatactattaagaataaaagtaagtttaattagaaagtaaataaaagaagtattaatttttaaaattaagaagttttctaattaatcttatttatactattattattactagttaatatatatatataatagaatactttaattatattagtaacttatactttttttactataagttatataagtatatagtaatataacttagaatctaaatctatctatatagtaaactatatagttttataaagaagagtattaataaagttaaattatagattaaactcttaatttaattaatagtaataaagagatcttagtattactacttattccagataatagtctactaattaagatattagataagcttaaaaaagaaggattttaatatatatttactatagaatattaagctataagtataaacctaagatagagaaataagtatttatagaaggtatattttattaaactagattaaaggcctaatccttagaataatatagctattaaagcagatataagctctatctactaaagaagtaagatcttctattagtagctttttactaaaagattatatagtaaatactttaagattataagagattataatttagtaaatctagaaactaagtaagtaagaatagaaacttctatttagtaaactatataaaccttctaaataaaatttaaagagatttataaaaagaatatagaaattattaagaagatagataatctagttatattaaacttatagttctattaactagaatctataatctatttaaaggattttagtaataagaaatagctattaagagattttatttctttaaaatatactttaaagctagataattctaaagctaaagataattctaagctttaatatatatatatagctactaaatatctaatttaaaaagtaattagtatagctaggctaagtataatcttatagaatatactatttaagataaattagaaagaactttataaaaagtataatatacccttttacttctagtttaaatactagatttagaaaaagtatattaatatctatttatagttctttatctatactatataagctatattttataataatacagctaattatctactatttaagcttactaagagctaaaatactgcttttagtataataataaattatactatagaacttattaatattaataataagattaagcttatactactattattatagattaataaattatactagcttcttaaagatattatacttactttttatatttctattcttaattactttactaaagttactaaaaataatagtattcttattagttttctaattatactaaatatctaagataataaaacttaggagatttatataaattttactctaaaactcttagctattatattataaattttaccctaaactatatatttttttctattggttttattataaataaaggtatatcctaagatcaggtaatatataatctgatatatattttttaagaatataattagtagtctatatccgaacctttaatactataagataaagttaaatattatactttcagcctgggtataggtattaataccttaaaaactctaataataggagctatttatatagctagatatatataaataacccggctatagctatagcccctaagaggggaagcttattatctaatagtaataactacctttcctttctaacttaaagcttactactaattacttaattaattaattaccagatacctagtaagtaagctataatatctaatataaatattctaatctcttagagcctgattaatacttctaataagatctttaaagtaataataactattatctaaggtaatctaatatagctatttactaactatatttattatatatccttctggttagttaagggcctgtttatagtaataaagctgcttttaatattatagatccagcagctgtatctgcttagtttattactttattatatagcctgcttagtgctactataggtacttatagaggatagagactagctagaagaaaagctatatcttaagaatagctatctacttatacaggcctattataatctgatatataatttatagtttcagtatattatatactatattaagttaattagggtagaagtagcttttaaaaattaattatttaagctttatattatttttaattatatttagatcagggtattagtcttattaggttaggtttagtattagtatatcagagtttattttagtttaatctaaaattatacttatttaggaataagaaaactaaactatatatatattatatatagaatttatcttttctactaattactatattacttagaaataattaataagattataataattatagtaattctgattataatacttatttataattatattactcttatatagtatatatatatatttatttcttagatagaaatactcttttaatagttattaatataattatctatatctctattattactagctttataatacttatatattaatagttgttaaaattacagtggccttcaaggtgtattaggccttgagaccgctataacgcagcagggaagttcgctataacttacagctctcaactgctaactccactattactcagtgagttttagtgctagagggacctaatatagtgcaaaatatagtacaaaagaatcttatttttgtgagagagatcagaaaattatactaatttctcttataggtctaccgactaaaaactactctaaaacccgctaaagctgcttcctgggccacttttgattttccgcaaaattcattactataggaaatctaaaaaatcaactcacaaccactaaaaccctcaaccgatatatatagcttttataagacctacttttatctgaaagaggctcttaagctgatcagttgagtaagtcgttgcaagtagtatcgcgaccaccgcatcgttcccgttcctcgcggcccaccacaacggtgtccgaccgtagctactctgggagtctggattgataacatttgttgcaagtaatagcctgaccactgcctcatgcccgttttctgacgtaatcgatagcggcgcctggccgaattcgtccagagagccaacgcccacccgtcccgttgcaagtattaactccgccacggtactatgtcccttccgtgccgcatgaaatagaggtgttcgccggaagttatccaaagagtcggggtcgacatcctctctagctaataacagcttcacaattccttcatggccgttcgttgcggctcgtgatagtggcgtatgatgattgtagagccttccgttagagtctgcgtcaagattatcctttgcgagtaataactccaccactgaaccatacccgttttccgcggctagtaatagtggagtccaaccatcggcagttatatattggatatcagctcctttctctaacgatattcgagctgcggctacttccccatgttctgagccccataaaagtgccgatcctcctgactgtttaatattataaaaatagagataagtacgtagcaaatggtaaaggcgacgattcgattgagctaagctattaatatctctcgctaattccagattctctgctatatagagaagtaattcgtttggcagactaacaaacgacatatctctctcaaaaactgtaggaagattatacagaaggccgggatatctgagggaaagggctcacctttaacttatcgtgagctgtcggctccgagcccccgtattggagcacttatggcggactataatatcagtttcacatgttggcaagctcccgatgaattataacataagttgaatgatccctccacaatcgataagcgctcactgaggatgtgggggggagtagcaaatgcatcgtatccatggacaagtatcatacttaatctccccaagggaaactatatatatttgcttttgtgtatattaaactgttggcgtttaccggcccgcctcagtacagcaccatatatcctataatagaatcccaaacaaaaggacattccgaggcgagtgagtatatatctttattctccaataaagcgctaaatacctaacgcttcacgaggccagacgcctaataacagggcagagcgtctccaagaaatttttagaagggcattacatcgagatctccttgaccatcagttagcacttagtccaattgctcgatcataacggatatattatatattaacgagtatggcttctccatcccgctggccacctgaccatttggggcctactatatagcgttaaatagtagaaatatctcattcttgattctctgaattcaatgcctcccttagataagaacaatcatgttgcgccacttgcttattgagctcactctatttgcgctcactctatttgcgctctgcccgttgggcaaattcattaaactcagcctgcaatgggctatatacgatacagatccccagactgtacttcggaagctcggcgaaaatagtactcgagagctttataaaaagactcctattacttactatgataccaatcctccatcctatatctgggatgggctcatgttccgcacaaaaaccagacgcggagaggaactttcagccgttaaggctcattttgacccttcagcatcagacgccccagagcgattcctctggaaccaggaggcggatagtaatataataatacccgatgcgcccgagagattccgctgcgtctgggatcggtacggcaataatatgtcctttgcctgccagatgcagtctcttctgaccgggagaaaggagctctggactgacgagcaagttcgttttgctgaacgttgccagagtgttacttggggggatcttgtcggttttgggccgaacccgaatccaaagtagcgtctgaacgtcactggccacagggctgtgatggacgacgtacaggccggactcttccacctaatggagctagaagtgaaggttttcaagcacgatagcgaagcggtttatgaaaatatcagtacatacttgggagagcgtggtatcgtgttatatcataagcaggagccaaaaaccgtaagactgtttcacgctatgggctgtgataggagttaccgtctggtgcaacagtttggactcgagacctaaaacttggtcatcgtccactatagagttcgctggaaaatacaaaacttagcaaaggttaaatatacttacgaccggcttgtattccgttagaaatcgagggagcaaaatacaaaacttaggtcaggttaaatgttgagttatacagattcaagacttcggctctgggattttggccctccaagtctaagctgtggctattgagatgtggcttgaagtggcgcattttgtggcggaggtggcggtgtcccaggtgttgctttcgagggggcggaaggaagagcctttcggaacgagcctgagaagcaaggcacaggagaccggttcttgcaggcccgccactgcctgaaggaacgagtccttcccgtgagttgttgaggctttgcgagaattatcgcgagacccttcgcgagtgtggctggtaaaggcacggactatcttgcgttttgaagatcaatccaagttccggatctagcgcacgggccaggaacgggaaaacaggggcaaaaaacaggaaaggaaagagaagaaagaagaagaaagaagaaagaagaaagagaagaaagagaagaaagagaagaaagagaagaaagagaagaaagaagagaacaagaagccactaatgttcatagagacatctcgtcttcacagccaggcttttaagtctctgcaccgtatcgaccatagcctggtccagcttattacctaggaaatcataggcctgtacagggctaagaagcttaataccttaaagtatcgtgcacctggataactggacgtagaggctggtaaaatcatacttagagggttcgctattagttatatgatttccctgtagctctaagagcacctcggaaaatattttagattaggacttatagttagtcagaataaataccgggataactggtagtccccgttaggtacacttcgtagataaaaatttgaaataggagtcagttagattaatactgtacaagatagggcggataagtactagctccgctgggagggcagggaccgctaaacttaccatctccttagattataataagattcctagcagtagatcgaagtatatagtaatattatccgtaagatagtaccccgggtatttcagatcaggaataatatctactactataaactctgcgctattaataaccttcaagctagtatatatattcttattaataactataggtatcccctgagtatagaagaagatacccaggaccttatacttagagttattcccttgctcgatcgcctgggctattttatattaagagagagtagtacttcgctacctatatatagatataaagacagagatatacttcctattaaagtatacccaatctataatagtctctatattaaggctctatcagttgcagttcagaggtattatagtatataggctattcctaaaggtaatataggagcagtagactagttttgtatttagtatatcaaggtcttatcttatctaagtactatactatactctattcagaagcttacccagttcagggttatcttatatatagacctgttcttcgagaagaataatagtcttaaacatcagctacagactgaagccgtaatagtgagaaatagcggcctgccccgctgatataataacaggatctactatttagtctaccaggaggctcatctcccgtactagggcgaattaataaaaatcccctattaaaagaataataggaataccaaaaagggctgattaggacagtctctgagcaactggaggcggtagctggctttatacagggtagtacctccgagtatactaacctcattaatcacgaggaccagcttctgcttctatatctatttctttacctcggagaaaagagggggttttttatcagaggagcactagatatctaatccgcaggctgaatataatattatactactgatatataccgctatactccctgatattcctataatacagagaagatataattagcctcttgccgaaaagatctatttaagggccttaactaccctggatttatctatactaccgggacctccagtatactggaagtattaaccggctgagtcggggtctattatatatctatccaggaacccgtatataagttgaagagctaatatctacagagtattaagggtatagttctatacggaaacttattctagttctataaagctagatatcttattaatattaataagtatccgaggaccctgtatattagtatctgaactttaatatagcagcagaatctgaatctccgtattatagttacaggcaagtatattatctatatcagtattaggtatagtttgtatactaccctgtggacctatctcaatcttatctagtatccggagatagagtatcttctgggcctttataaccacctgaatatcctctatggaaagggtctgatattagtacaggggggtatcttagctatagcagagttactaatagaagcactcaggatactggactaagggcctatactccaaagctaaagcctcttcttataggttacagataaaagttattaaaactggggaacctcgcgtagtatcggaatcctatactatattatatagagtatagagtaccgctgtaaaactctagtaatacttagctgttatcgcaggtaagttattattattatacttatcaagggggaattctatatcgactgtattatcgccttctgatcggttagcccagagctttatatccctatatatatcctccgctgacttactgaggagggagatattagagatataaaaatatagctggtaatagagagaagctttatatccgagctataaattagtaatatcgctgtatatattagaaaaaaagtattcctaaggtataaatagagctagatagagaatagagttactagatagaaatataagaataagcctcggggttagcagtataagctcagggtatactgtttgaagtatacagggtgctcgttatagtagttatcgctgataaatccttgaaaaatcagtacggtatacttataaggtcagcggagcttctgcaaccagctatagcacgctacagagggcctgtcgagaggtacaagggatatatagttcttatccttatcccggctacagctacagaccaggttaattatagatatgtaattatagaggtatatatttatcaggacccagcccctgcaggtataagcatccaggcataatagggtccacctaccttccctgagctgtactaactctgggggcttcttagcctctatctctgcaccagcctggctctggagatacttctatctgcagaagatagcctagtataatacagtcaggtttaagaaggactagtacgggatattagtaaagtccgtataatagctgagtatataataatatacctcaacagctgagagctatctctcggaaaaaatccgatttactacccttatcagaaactggtagctctggttccgaacagcaggtctttaggtgccttagtcggcagatactgatatatcctgccccggcggggtatccttgtaaagctaccggaggacatcagctatataggtaatttatctctatataggtatatctagctttatagtatagttagtgatgtaaaatactatagccaggcccttagtccttgttaagattatcgatatattatagttatagcagagaccgactgctatcgctctattataccggttaataagcgggtagttgcgacagatagtaagcaggttatcctcgctcagccccgtcgtatccacgatcttccagggcgccttgaactaacaggccgtccgtctgtacttatctgtatcccggcttacgaggcccttcagggaatacttaatataggtataggtataggaatagacttagcagcagtatataataaagttggactcggtgttaaaggctgcagatagtacctcggtattattcattatctcctcgacagggtagatcagcttccgctcctagcggagagtctttccagtatccttatccaagtactcgtaaaagactgagtctatatagtgtagcacccgggtataatactcttcctcttgagggtcggtgatattatcgataagtaatagtaactctatattaccatacaaccacaggagcccgtgcaggtacaggctactacagttgttcgtctctactgttacatagtaatagctgaccttgctaaagaccgattcttagtctgtacgaatatacttttcgaagaacagagaaacctctctgtagaagaagatagtagaactgaccgggtctatagtactgagagcgatcttattgtatcttccccgaagatctgccaacagcttcttcgcgatgtggtagtcgtagagtctgtggatagagagcttcatcttgaccggattgttaatatcattggggttaatggtgaaccagatcgcgggcataccagcccagatgttcattacttatatttttctccgtatgagtagtcgggtttcgttcgagagaggctgcacatggccaaatatagacaactcacggagcaggaataccacatctgcgtccgtcgttattctcgtttctcgcatctcgtcctcagctcttttcagccggtcccgcgtcagggtcgcgtatagccgctcaacccgctcgaaggaggccttcgttatgcgtaccatgctgattcgtcggttagaagaacggagaaggatgttgaaaacaagaaagcaaaagataagatgggtggtaaatcggcccccatgtcgctgcagcacgtacttggcccagtaactgagcgagtggtttggctggtgctcagcagcctcctggatgggctgttgttggcttcggccagatgtatacaccgcctttaggccacctcttccccaggggaaaaggctcgggaaggtgcgggggaagaagtcttcgtgcaggctgtctgcaaagtccgcgccttgttctaccaagatgaacggctgccctcctgtagcttggacctgaatcgcatagggctcagccccatccttgctaccccgagcctgacttttctggatagcctcggttaggaatgaaagcttatcggcctcctcgaaagcggccggcccgtcaaggggaaacatgccggacgatgtcgtctcaagaataacgttaccatcaccgtcgacaaactccgatcctggaacggaggcatggggatccccgggtaagggaaggtcctgttcgtttggaagagtgccaccagggagaccgggatcgtcgctggaggagtgagcctgtgccgacgcaacaatctcctcaatggtcgtgaaatagttctcctccaaacctcgatcggtatctggaactatgtggtctgtctgtgtcttctcggcaacggatggctcttcccgctgcatactgtccatgatgaggataggaacatccgagccgtctgcgtactgccagccatctatctcattatggtcgatcgtgacgtgctcgtaaagcggattgttttcctgaagccacgaaagcgcagctcgaacgtgggacttacgcactcggagaagattcccaacgtctgcagcgccaggcttgctggagccactccaagagacgtggatgttctcgatggtaacgagaagagggtgagggaggactgtggcaacgaggtcgccgaccttgtttaggaagacgacgatatggcccttcacgtgcttccggtagctgagccccgacggggtcttgttgtcgacggtgaactttgtgatatagccgaaggaggcctgcaaagcaatcagcctctcctcaacgggagacaggccgtcgagctcttcgggataccgatgctcacatccgatgtacatattgttgaccgcacaggtcttcggcagtttccccctcttcaagggggcatagcattcgtagcaaaccatggcgtcagcgtcgtcgtcggcagagaaatagtccctgcactcctggagtgctgcagtggcctgtagcaaggagggcgtcaagtgcctcctccatcggatctttgtgagctcggaagggggctgcttcctgtagcaaaagttgcagtgcgagatcggcagcgtcctctcatctgtgaatgcctggtaaaaggactgcgcagtctctacctggagggtaagtggaacctcttcgcaccaagatcttgtctccgattccctctctttgtcgcggaaacgagattcatgatatcgcagaatggtgtcgagggactctcgttggagcagggcggtttctcgcgacggcctcgttcttttccggggccggtctggcccggtgggcggcggggtcagaagtccttctggttgtggttcccgaaggcgctttctgggaggcggggtctgtgggattgcttggggaaccgggattcttggagagctggtggtccgctccggagtcgtcggtaattgtctgcagcgcacctcttccgctcttcgacggccgaactgaccagtctcatgttgtggtcgtagtcttgcagttctttcacgccaacgctcttccgcatgtcgctgcgtgatagccgccattgtgcgcctgagttcatcatctggcaccatgacggtatcacgccgggccactacctgcgcctgatggccccgttcttcagcgcgctggcgttgaatatcatcccatgcacgagcaacctcgccaggccgaactcttatcgcctccttctggggctgggtgggtgtctgagatgctagttgcccagcggtagtggagcgggatgattctcgtcttccacgggtcagtgtgtcggcgtgttgtcgatccagatcgtccaatttttggcggatttcatcaagcgggactcttaccggctccttccggggcttggcctcggtcttttgagactcttgtcttcgtagagtgcatctttcggcgtgtcggcggtccaggtcttccaacgtagttcggatctcgtcaagcggaactctgaccgactcttgacggagccgatgggtgctctggtatgccgaggagtttgagacaatcgagtaggttggtcccgaccttcctccagctccgtttccagtgcgcctgccgtcaagatcttccagtgtgcggcggatttcatcgatcgggaccctgaccggcttttcgcggggcatcgtacaagcgatctcgtcgtaaatatgtacgcagaaagcgggaagcagagggccaagcaaacgcggcgatgctcgacatgaaaaggaacttgggcgagggcccagatgagacgttgacatgataccggcgacgtcacgggtgacgcggaatctcggccaccctgtttcagaccacatcgtcacgggggcggcgacagtctcgtggcaactcctggagccaccctagaaccatggtggcctttctgttattcaaggctgggtgaggagcagacactacgctaaccgaccggatccgcgtccggtgtcctgaggctagcttcttttcatgatgaagcgagaaggcgtagggaactcttcagcgaggtcaagagagctaaataaataactaatagaaagtataatagaataagaaaaataatatctagtataaatatatatagataaaatatttaaaagaagaaaaatagctaaagaatattttagaagaatatagaatttataataaactatttaaaaaaacttttaaaactagtttatttaaatatagttaatagaattataaaatctctattattaaagaaagagaattagttttttataaactctataactttatagaattttaattataaatactttataaatatattaataatatattagtaaaaaactatatataattattaactttatctatagattattttataatatttatactaaaaaagaatagaaaactataacttattataaactactaatagcttaataagattatatataaaaatagaatactcttattactaattatagaacttaaagactaattataaagaaaataatagtttatagtactagatcttaagagaacttataacttaatataaattaaaaaaagagataaataaaaaatagtatttagaataaagtttaatctctataagtatcttataatattctttagattaataaatatatttataatattctaataaataattaattaaatactctaggagtattttaatatctttataattatttattttaataatattttaatctttttaaataatttagaaatatataaagaatatatatataaagttttagagaaactagaaaatataaaactcttagtaaaactagagaaaaactatttctatatataaaaaattaatttcttagaatatactatttaactaaataaaatataaatagaataagataagattactatagttaagaattagaaaatactaaaaactattaaggaaatataagcttttcttagatttactaactattactaataatttattaaagattataggaaaattattatacctctatataatattactaaaaaagaaataaaattctaatagaataataaataataaaaagtatttaataaaattaaaaattaaatacttttagaacttatactataaatatttaattttataaaaaagatagaacttaaaactaatactttagattttataattaatatataatttaattaaaagaataataatagagtattatattctatagtattcttcttaaaaaaactatatagtatagaacttaattattctatttataataaggaatttatagttattatatatatatttaaagaatttaataaaaataataaaaagaaaaaaaatagagtaattaaaattatattaaaataagttatagatctaattaaaaagtataataaattctaatactttttatagaatttagaatatatttagatcctatagaactagaagctataaaaatatatatatattataattataataagattagatatattttattataatatttaaagatagaagaattagaaacttattaaagaaagtagaaataactagaagtaattagaaaaattaaaattaaaattcttagaaaaactatttagaaagtaaaccttataattattataatttttaaattttctctcatctttatatctatttttattaagatcttagaactataagaatattagaactaaagtatttttagaaaataataataaaaaatctaataaatttatataatagtttaagtaacttatactaaataagggtctagggtagattagagttaaattaatcagagtattattctaagtagtataatcaggttattataggctatataatataagttactattaatatataagtattataaagctagtaataatagatatatagataattatattaataactatttaaaagagtatttctatttagaaaataaatatatatatatactagttatagagtataaggagtatactacttctagtaatttaatcctattctattataggagtataatacttctattacttctatcttccagactatagggtatatataactatatattctattataaaggtctttatttataatataatatcttctctctattagttttatctttaagattctatataattttagtaagtttttcttctttctatatataatagttatattataatatttattatatttaactatatctaaaagctagtatattctaaaacttataaataagttctttttactattattatttaaatatttagtttactagctaatatactatatactctatattttaaaataaagaaagaatattttatttttctaaataaaaggttatcttattataataaatatacttaaagtagttattactataataaagtactagttatatctaactataagtacttttttatatttctttctatttttcttttttaatttctttttctagtagaaaaatcaataatataatagaaaaaactaactaaagaagaatctgatataaataagaagattcttcttttatattaataaataacttaattttagaataatctttctattactttaaagtatatctagtatatttataaagtatatagatatattaaaagtaaaatataatagaaaatttaatataacttttaacagcttaataagaaggagtaattattctctaattaagtttttaacttttttaaggcttctaaataatatactctagaggaagtttaatttttagaagttatttctaaaatagatttaaatctattagattctaagagggattttctaatttaatttctctttttccttttaatagaactagtaaattaaatattaatattttcttaagtacttaatagatttctatatattatcttagttaatatattctttctatttaactagataaaatatttatttatttctaatttctttctaggattttttctaatttatattcttttttatagatcttaattaaataatcttaatttagaatattttctagtacttttttaagtaataagatataaaaaactagatagatatatattatatctaatagtaaaagtttataattaatatttaattttttcttaataattttaaatagtttaagttttttataatttaatttattacttagttttattattataatatttttataaagtagatagatttatccgcgtccggtgtcctgaggctagcttcttttcatgatgaagcgagaaggcgtagggaactcttcagcgaggtcaaggagaaaagggggggggaaagagagagagagagagagagacagagagtgcgacagagagtgtgacagagagtgcgacagattgtgtgacagattgtgtgacagagagtggtcggtagtagatgaactgaagttgtggctcctccgatgtggctcgttttacgaagggtggtggcttgtaaatggtggcgcattaaaaggggcttagaagtgctcagatcgccgagcgaaccgggcgttgaggggttaggagggcgcggaaggaagatccttcgtctcttacgttcctcaggcaaattgccttaatgcgcacaggcgctagctttcagccccgcgttcggtggtattacacccccatcttttatttttaagcatcacccgaccgggacaagcatgaggagttcgtctgccgctaccgcgccgaacttgctggcggggagccggcggaggctttcgagcatctgcaacagcgctgcaccgcagcaactgcctcactctgaggaccgccactaaggacctggagtttagccaggctcaagtcctagcagacctgctggccagatcataacggacccgaaaacgcaaaatccaccagcttgttggtagtgctttcaactatgcgcattgttgacctagccgcatgaattcgaagttctgggctcttcagagaaaactaggcaaatggatagcatagtgcaagaagccatagtcatctatctacatctctttctccttctgcttcggcctcttgctcagtcgcttctcccggccgattcgcggcgcctcgctcacgcccccccgcccctgtatatcgcaaaccccatttctatctgctatcgatcgggaatagtttggtaatctgtagagtttcttcaaactccttgggaaaaaaaatccttacttcgtttattatataattagtttctgagcctatatacttctccttcctggtgttagtataccaaaccaggttctgttaaccctaaaataaggtactcaccaggtagaatatctatagtaactcttattcttcagtgcttgctgaactctagctaactatacctatatatccttatattcctaacctatagtattagtcagtatataaaggctaaagccttctaagccggtcttaagcaccagcctattgaactgcctaacttccttctacttcttatctaccggctacccgcctataggcgtcttaatagtcttcttctggatattactaaagccagcttcatctatctacttaacctacttattattattaactaccttgaaactgtaccccgtcttctcgctaatactggcgaatacctccttctaccccgtccagacgctatccgctggtagggacctattatccgactgcacttatatactacagtctaaatactccagccagccgcccggcttaaggtaccggaagcactctttatataacgtaggccaatccttaaagtatccgagaaggtagcggatgtggatatagtcgaaagtgttgtccgggaatatccactcctcctgcgaggcatcatctaattcgaacttgcagttcggtagcacccagcttagctgggttggcgagagatcgatacctatcacctcagcctggggttctcatctgcaaagtcgctagcgcaatagttagtacatcgtatagaaagacacccgcgcagccgccgctcaaataggttggcttacatagcccagatacctgttcctataccaaggtcgagaaccttttgcaggttctccaacggtacgaggaagagtttattatcaagtactagattcagtatataatagcttaataggtattagtttgttattatccttaggatatagtttttagtaactatagtatatactttatatcaagcccttcgttttgctgtttatcattaggtcccctggcggacacttatcagtcacctttagataattactactcggggtaagggaaggtattaataccagtattcagcagccttgaagttatagtatatccttccatacagcttgcaatactctagaatcgccgaggctattaaagctgtagagaggggcctattaaggattagtatcctccaggttcgaaaagttagtatcagcagagtatatatatcaccaggagtagactcgtgatctttatcctggaaacctggatcctatagtaagattcagactaggtagcttagagagggatatagattccttacaatagtaatacagtcgactggctcagcagcagtatctggagccagtgcagaaattagtagctcattagattccgctatagcaaaggatcagactttcgatagctcgttaatatcaatcccaagtctggtttaaatatactgattcctccaatacagataaggttatagggttcagctaacagctgaatattaatatatagcagcctactttgctaatattaacaagcatctatcagctgccctataaatttcctatagatcgaggatctcctcttattttgattatataatccctcaagcagatctaagaaagacggactatagataaaccgaaattttgaacagagataaggtcgctcgctagtcagtctctgtacctcttagtcatctataagctttacgaaccaagtgcgtcataactatttgtattactactgatattatccttcgcaacaggacgaaatgccagaagctagcatagcatgcggagctaaactaatagtatcagtaattttggtctctttgatatagctcctactcgccctacttcgcagtacggattcgagattaccatcatctgtaccctcactatcgaggcggatgctgtcgaggcaatcttcgaccagtactgggataataaatactccttcggtaaggcgtccggcgatcctaatgcatataccactggttctatcagctatcacaatatcgttctcgcccatatgcctggtatagggaagataaatactactgttgttgttgccagaccagctatcccaatatcaaactggctcttgtcgtcggtgtatgtggtgctgtgccctttgtatcggattctgctactgaaattatcctcggtaatatcattataagcagtagtatcgttcaatacgacttccgatgtcgacttcctaagcgttttatttgcaaaaacctactattagactccttaggcaggcctaatttggagatccgcatataattagagaagctagagggcaggcgcagtaaggcggtattaaaaaagaagattatcagtcatcttagagagctacagaaagaatcggatttacaagcgtactatcctggtacagcccacgataagctgtttatagctcattatcatcaccttggggataggaagacatatgaagaatgtggatacaatggagaacttatatcacgccgtcgctttgaacaaaacgatatacaaccggcggttcacttcggatttattgcttccagcgatgcagtgatgaagtttgggcaagacagcgataatattgcagagcaggagagcattatcagctttgaaatagagagtgctggtatctgggatacattcctctgtatagtaataaagggcgcctgcgactatgctgacagtcacaagaccaagaagtggcagcggtatacatctgcaacagtggcggcttgtacaaaggctttcttagaattttgggagccttcagctacaggccaagccatcgatcaaagcaacccaaagtgtaagtgtacgtaattaggggtagggatatatatactaattggattatagccattatgctatatcctagcaatccggactttattggacgccagggtatcctgcaccaacttaaagaggacctaggctatgcacagcagaaaactacatcctcttacttacaagcgtcgctctttggcttaagcggtatcgggtaggctttttctagccctatctataattcaaataggggattattaataccaagcaggaaaatacagattgcgctggcttacatttactggctgcaagagatataccctgctgtatcagtcttgtgggttcatgctagcagcgctgaccgcttccgccagtcatatatgtcgattgccgaagagtaccagatccctggctatagcgatccaaaagttgatatcttgcgattagtgaaaggctggctggaaaagaagggcaatggccaatggcttatggttcttaataattcagatgatatgcagcttttctttggttctccggcagctgcttcaagcttaactgggccaagccaggcaggccacttctcggattacctgcctgagtgccgccatgggtctctcatggtcacgacaagaaacaagtagctaggtgtccgactagctaaaggccagcagccggttgaggtaagccgtatggacaaagatgagtcagagcaattacttctctccaagcttggtaatattagggggccacctgcagagttatcatcattatcgtcccaactggaatatctgccgctggctcttactcaggccggttcttttatccaagagacctgcataacagtagcaaaatacctccaactactaggcgagagcgatcgaaatatggtacagctattgagtaaggagttcgagactattaggcgagactctgaggctcctcatgctgtggcacaaacgtggattctctcatttcagcagatccagcaacagcatgttctagcaagtgaactcctctccttcatgagcctcctagattgccaggacatcccagcacaatttctttcgtactatattgaacaaaaagaagataaggaaccaaaaagcgacttagagctcacggaagcattgggggttctgaaggctttctctcttgtgactgaagataacaacggaagttacaatatctatcgccttgttcagctagtaacgcgtaagtggcttactagcaatagcacatacgatcgtttcaggaaggaagcattaatggtagtgtcaaatctttatccctatagtacatataagactcgggcaatatgcgctgtatatttgtcgcatgcaaatattgtgcttagattgtgtgattccaactcaggagatgagggcgaggcaaaggtatctcttctttattgcgtggctgcataccccaggttcgaaggacagtgggatgatgcagagccgctcgatatagaggaaatggctataagaaaaggattatttggggaggagcatccttctatactgacgagtatagccaatcttgcattaacattatagaatcagggccggtaggaggaggcagagaagctcgaggtgcaggtgatggagactcgtaagatgaagcttggagcagaccatcctgatatagtgacaagcataaataacttagcttatacttagaattctatagataagaaaactatagctatcgacttgatacaactatgtattcacctcagagagattaaactaggagtggaccatccgcatacgcgattatcagttttagctcttgatagttggtaaaagtaactaatgtatacaaggtgtattgcttatgtatgatatatacctaccctgaagtatcttatattataagttggatactgtacataactgaggtgctatttggctgcgatataggggtgcctgtttctaggccaagtctaagaaaatagagcaaagaactgctttagttctaagtctcacaacatatagatcttgtataaagtgtattttgtagaatataatactgtatggagaatcagtttatattcaacatatgtttataaagaggaagctagttatgctccaaactgtataattaaatgcgaccaactgtgaccaagggcaaccaaatgcgactaaatattggggcatagcagcgggtacagagtacattccacggcgcccgctacagaggcgcccgggcgcgcttttagaatccgcgcgcccggacgcgcgaattatgtcagcagtcaactccagtcacaacacaacagcagagatcagtcagggggagccgcggctagttattaacacgcaaaactttaggttctaagatctagaaaggcaataaatccagaaagactacttagttaaatataagctctgctgctctctattatcctttgtagcggcctcctatatctctcgtatacctcttctaccaacagaaaaaggattactttctatctctgtagctacctgagcctcaacccgatcatcttccgccttactctaatccaggtaagctattatctcttccttagtctaatctctagaacctggggataatgtacagcatgcacctatctgcttccagtctaggtactactggtagctcgctttattatattgtagaggcagacctatcgccttcctgtattcttaattagttttagtaattctactgagttaggccttgtactatatgtctcaagcgataatatatctctgatagatagcccgggggttattatatcttaataaaggccctgcccctgcctgtattaatagcgctactagtgatactactggtgttctgctacttatactaccgatattaataataatacaaccgggactatctctacctgatcctgtatactctgataatcccgatagcagtactataggtacttccagtatctgctcgggtactgctgccgataataataatactactgataattgcaaaagctcttcataccgctgagggcatactttccaggttatcttatattctaacgagtagtatctgctacacttaggctgtgccctcggctgtaccgcggcctcaactgccttaaatacactaggctctcgcctcgtgctttttaccggctggttatatctcttattatactagctcgaggctgctctaggctccagtataggccgtggttagtctatataccgcttcaaatgctaatgaggataaaattattctagtaagagggtcttcctttcttcctccagctttttcaaggtatatatatacagtagtctatataataatataaatctctgactacagggagctttaagtactggaatcaactgttattattcttataccttgcgtagagcctgatataagacctaaccccgtatagccttaaataatactccggagatatctagaggtatctataactattaagaggcctgtatatagtttagttctcttaattagttagtaataactggttttattacttgctaagtattaaagaggtctagagtagaagtcttaacatataattttattagggaataaattccttcagccctaggaagtttatcagtatctatcccctatagctctacagccctataagctacctgccttgaggtagtaatattactgaaatataagtatttatctacctatactttaacaaccatctccttatatagtttaagccagactgtcttaatatatctaacggcctctgtatactttttggtatatttgtactcgaagctagttaggcgctcctaaaatactgctttagttggagaggctataattaagtaccaggatatatagaatttatcctataccttttctggctggtctctactgcccagtataaagataggtcggtaatactataagactgccttattgatataccagaggcaaagcagtaacttagagagtgggaaccaggtagctaaagtatttattactaccagccaccggtccgtcaaaataactgaaggaagatcatactggtaaagggacttaagatattataaggcctacgagtagtcctcttctatctcaccggagagaaatacaaaggtaatatagaaagagcgttagcaggagttaacaccgactatattaagaagtagtatagtatacttatttattttataggtataatctaatattaagatatcggggttatattacagatatataatagaatctgggtgggtaaagaagatagctattagctgattatcagaatccaatcagactctatactagaaaccctccctacttaattagtcgactagtatctggatactgctttgaccctcatatagatctcgccttatagctgcaattcgattgtagatatccttctgggttgcgagggtatcagagtatttctaaagataggttctaatttcccgaggggtagctccagaagctttaagacttgatatagcttttatatcattttccttcagttagcggtacacagggtgtacagataggtctccgctcggagggtgattatatactatatattcctggctcggccggtggcttaagacctatgaatcccccccaagggattatttggcaagtactgagaacttacaaccagtctctcagctgtatgtacgatgtgtcctttcggcagatgtacttggcggtagcttgttccgatcatatataaatacaaccttgactcaaccgtttggggtttttaaggatttccccgtcgtgaaagtatagcctctaagcttcgcccaagagttaatggataaaaggagagcctccctagagtcatatatgccctcgggcgggagtacatcatcaggaaatgttgcctgagccatgatagggctgatctctgctgttgtgttgtgactggagttgactgctgacataattcgcgcgtccgggcgcgcggattctaaaagcgcgcccgggcgcctctgtagcgggcgccgataatagctcttacttgaatcacacggactgcgtatgccgagttgcgtacgagacccaccgcctacagaatgcactaaagagtgcactaaacaggcccgtgcaaagtcgcgtacgcgaatggccgatctctcgagtacgcaaacgcttttcctactcggcggatcgcacaaagcattaccgcgtacgcagagctagagttacagcgatcccttgccagcgtcatcattcgttctgaataccatgtcgggccttgtctttttaccaattgcgtattagcgaactacagtaagactccccaaaacagcccgagtatcaggtcttgcattcaagtgacaacgttaccataaagccaaccaatctctcgctaatagtgtaatatcaaatcacatgaacgctcctttcactcctgcgagatcatgcaagaaacctggctccagctggctcttaacaccgcgaagacgagataccgccttgatcccccccttcgtatcttgaacccgctgccgcttgttaggctccagaaccgccagctgtcgtcgaggtggcaagagaagccgcgagcgctcgaagtcaattatcattacccctttacgtatgacgcttaccagccgtagtgatctcggggtatgaggacacctgattggttactcatgctggcgaacaccaattggccagtcttggacacgagcaaatgcggggaaggtgatggtggcgatttagccctccatcaccttgatagcctttggtggcgaaagcttaattaggtcttgacgtcagtcagtatctactccagcggtctgattcgcaacaacccctatcagctctcataactgtcatggaaataaaaacagatcagctggaagctgtgtaaagaaaatcgtcaaccagacaagccttgcgaagtacacaatcgatcacatacaccatgcctggactaccagcttaccgcttcccggtaggttgtttgccaagatgtaactatcgcacatcttcgcagctacttaaccatcgtcgccgtttcaggttgccatcaaatcatcgctcaatatcctcctatgtcgtgaacccgaggaatctgtatgaagctatcaagacggccccatctactatcgccctcgaaccgcgaatcattcctctatgtgccgcttggtttcctgccaatgataccgagggtcgtacaggtttccaagtcttccgcgagaaacgaatcccaggagctcgctttttcgacctcaataaggttatcaatacgcattcgccttatcctcatatgttacctagcgctgaggattttgctgcctcaataagcgagctgggcattcgtaaagaggatatcctggtagtgtatgatactaaggagctaggtatcttatcggcaccaagggttggttggatgttgaaagtttttggtcacccaaaggtacacatcctcaataatttcaggctatgggttgaacaggatctgccgacagaacgcggggaagtatacagcttcagccatagtacctatccagtttctaggcttgacgacacaaagcttgctacctttgaggacattcgtgaagcaactgtggactataataaggagggtagagagggcatacaggttctggattcacgatccagcggccaattcaggggaaggcatccagctccacagtcagactcttcagggcatatgcctggctctatcaatatcccctatgatctaatgctggatccggaaacgaaggcattcttaccatccgatcaactgaagaaactattcgaaataaaaggcgtggatcctctaaagccgattatttcgagcggaaccagcatcacggcatacgtgctcgaaacagcattaaatgaggctcagttcggctccccagattcacgaaaggtctacgacggaagctggaggtgagtttcttctataggctattacaagctctctcccctgactatctcacagtgaatggacgcaaagagtacgaccatgggattatttggttttaaaggaacaaaactcctattagtatttaatttagagtatggaagatgaagtgacctaatgctttgcagtagggaaacaggccattgcctggacagcatatccctccttattactgtatagtacatgtaataagaatagctatattcccattttaaaagtaaccgaagctagtcacagtgtgctgttatagcaagaccattccagaccaagtataaggatcaggtcagcgaagtaccacacttctatcaaatccagcagattcaggtccgaactaggatcttttgatagtactaagaaacctcttcccaaatcatagtttcccattcaggataattcgaaaagctaagggtaggagaggatcttcacttatttttataacctacatactcttttaatatcctatccaattataggagtatagttatttgcccataaagataaccctaattatgggaggcataaacatgatagcctctcgaagcaaaggccggaagggcccactgaaaacccgatgctaggtcttttctcctcaaatgatccatctctcacttggtgagtaatacaaaccacctcaccacgctctaaatcaagcgttttgccatctagtccttactatagtatatgttcacttcgcgaacatcctcaaagctagcaagctttgcttcaccaggcatagggaccggataggtgcaaggttcgaagtcatatattgctccattttctatcggtaggtcctgttcagcccatagcctgaaattattaaggatgtgcacctttgggtggccgaaagctttcaacatccaacccacccttagtgccgaaaaaataccaagcttctcagcattatataccaccagggtatcctccttacgaatgcccagctcgctcattgaggcagcgaaatctacagccccaggtaatatatggggatagggtgaatgcgtattaataaccctattgagatcaaagaagcgagcttttgggattcgtttctcgcggaaggcctggatacctgtgcgaccctcggagtcatcatctgggaaccaagtggcgcatatgggaattattcgaggttttcgaggttcttgggagatgctggatgggcttatcctaagagctttatgcaggtccctcgggctcactaggaaggtggagaacgaacgatgatttgatagtaaggtgaaccagccataatgattgattgagtgcgaagatgtacaatagatacatcttggtaagtgccgctttaaaaagagataagcgccagccatgatgaacacaatttcacatgtcttattagcctttggcctcgcgaaaaatcacgatcttttccaaactggcaagctggtctgttgtcggctgtgatagctttgctttgcgggaaagattttttttttgggggggtggggggggcgcctgggccatcaacaaagaaatttgctgtaatagggtaagactttatagcgtcacaattggctccctgacgtcagggtcgatgttggtttatcactaaagtttgacttcccacgatggttggtgctccaaagggaggatccttgcctcccggctggagcggggctgggtccagtaaagagttgaactgaatacgattgggcttgcgtttgtgactcatgggaaacaacacattttcagacagcccttagcttgatcggcatttggctgctgatcgatgaaagtggatgtgtggctgtccaatggaaggagaccttgtatttctgcctcatgtcttacccttgtacataagcaagctaagatccatacctaggtatatcgccactgcggggccggaaacgtaactgcaagtgccaataccgtataatttcgcaaaattcgctgaaaaagggccccacattgcacccttgttcgtatccacaccaaatacacccttgcaaacctgcaaatgcaaacaggctttccatccaagatcgcgcccgcccgggccctccaaaacgcgtcggtcaacagctaattcattaggtcaatagctagcccaagaggccagggctgcttccacgaacctagggatccttttttgaagctattcgcgatgcctcctttgcagccgagagatgtcaaccttgcggttacacctgcgaaacgtcgtccgggcaggaaacgcaaaagccttgaagatcgaatttacagcccacccaagcctgtccgacgcgttgaacgaagctatccggaccatcagaagatcaaggttcttatgtttcttcatcatcatcgtgttttcgtccgacgggtcaaaagcccggattactatcgccctccttcacagcaagaagcagccgatttcttccagatcccgcaacgcacgattggacagtgggttcgtcagaaggatgagattatcaaagcttaagttatagtataattagaagtatatagaagattaagtaatatatatatataatagctagattaaataatataataactagggatatagaaactataaatatactaaatagaaaatattaaaattagtaatatatagtaataataatataaatactactaaactatatttctaataatactaataatagaagaaagaactataatatatatataaagaaaaagtattttctctaactagtaatagagataatagtaatttagaggaattagaaataatttctattaataaaaaagaatagaatataatatataaagaactaattatactaatataaataaataaagttaagaaataaataaagaagtttaaataatacttatctaagagtataatataactaaataccttagaagaactttttttctatatattaataaatataaactagtataaataactaaagaaataaattaattaaataaaaaaataatctaaactatttataatagagctatagtatagtataatattaataatagattaaagaactctaagaataataaaaactagaagctctatttatattcttatagagatagagattaagaggaactagcttatagtatttattaattataaagtataggaaaattatatcttattagtagtaattaactaattctacttattataaagaaagaagaaagaaatctatataataattaatataaaaagcttaaaatttaaatataataatagaattattaatttagaaactaattattttataattaaaatctaagaaaagaaatttaatattatatataacttatagggcggtatatagcaaaaaacactgcaatgttgccatttcaaattcctgggatcagattaccccatagcctaccctagagtgaaatcttaaattctagatatttatagctagtaatataaaataaattttttataaatttttaataaataaatatatatatatactatttaattctaatttttttataattttaattaatttatttatagagtattagttataaatattatttaagagagattaagagtgatttctcctagagaagataaagataagcctagttgttgaatggctagatcacgtgacctaattgctaagctagctaggccactacgacagcctcttccagcttaagcgattttcccctgaataacatgtcgcgattgaacagcccgaccgcgacagcttcatccggctgcagcggctctcccttgaataacttgtcgtaattgaacagcccgaccgcgacagcttcatctggctgcagcgacttccttaaataacctgtaattacatagcttaaataagtgaattttatataaaatttttatttttattttaatattctatattctaaaataataataaaatataataatatataactaagcttatcttattatactatttttcctattgttattcttaatactttaagctactctttatataaataatattcttcaaagaattcctagatactatttttagtctattatatggttggtcaatctctgcgacattctggcggcatcgtgtgaaggcaaaattcaatctagcgcggtactgaggacctttcttgcccttccttgcaacaccacgatcgaagtctcccgggaaatgaaagggatcaatctcagtcggcaacctacgaaactagcgacagtcctcgtatggcgctatgacaggggcttcaatcgtgttagttatactaactagttcctcttcgattgtatatatctgagccgcgtgtcttcgaagagattaacactatttttattcattggagataacacagttgaattcttcgcatatgcataagtatatttatacttataaaattatagtactaatttaatctccaaatataaacaatctactctagtctcactctaaaatttataatgtacctaagttgtctatagataaccgatttcgggaaccttgaaccacacgtccttactccttaagggtcatactcaatacgaaacacctgagactcagctttatcccaatcactctccttctccctatcgccatagatcttcaaagctcggtacactatcttatacataccagcgggaacaaaactaccacctgagagttcgccgacccatgccccagatttgattcctgctggacgcgaaagcatcgggaaacctgccacttgtccaatactgctgttgccggatcgtgagacagtcgagttgaggcctgggatcgccatagggacaacatcggcagtcacctcgggcgagccaagggtaagatagtgagttactttcagatcatccagatcggcaacgttatcctcgtcatatattttcttgggatttggcaaaatgaaagtcgtgtttgctggtattaccacaggagactccttattggatgtatcaatgatcaaccccgcgtttggttcaagaacagtagcattgtgcaaagacccactcagtcccacatagggaagagaaagcaaagtgttgttctttgtacggagctcgatgaatccggaccaaacaggcaatttcttggtgtctaggcctttgggaggggttggacgcacttcaatcgtcatattcttgcctgaatcaactgtgatcgtagtgtcgctgagcttgagagtcgcatgctcaacagtcctttcattgggaaaggtatcaccaagggctgtgttcttataagtgtacactgtcaaagcggggacatgtgagatttcaagctcaacatccttggaactagtgtttatcactgtgaaattgagtgactcaggggcattatcggtgtcgttaaaggataggcccgaaggggttaggagcacctcagcatatgccgccttatgggcttgaataaggccagcaccctgctgtggaacaggagcaaggaatttggaataagccgtcccgttgttgaaaacttgcggagaggcagtagatgcgatgagattctcgatcaaagccggctcaaatgttccacgaacctgagcaatcagtgcgtagatggcagcagccaagggacaagccatggaggtgcccctgagaacagcatacccacccatgctcaggggatatgttgacaagatgctactaccaggagctccaaactggggtttagaaatcatatcccagttcgggccccagctcgagaaggagctcaccgagccgccagtaacgctatttggaaacgtattgatagtcatggaatctgttgacccattttccatatcaacgatgattgtcgaaccatttttcgtcagatctatccaccttgcaccagtctcaggtgatatcgtcgcgaatgctttaagtccatccacttctggcatctttgaggttatgatttccggtgaaggaccatagctcatgatgtactcggcaccagctgcaaccgcgaattgagcgagttctaattgtgaacattctcctttattgaggagagcaataacaccgcgcaggtcaggagcatcagtaaatggttcgcagctagagccgttgccaaaatcgtcgcccggcacccacaacggaagtttaacgcccttccagccgtcaggggatgcgcgcgaggcgccaaaagagaactttccacttccattaatgctgtaagatgacacgtttaccaaagcgaagaactcaacgttgtcaaaggaagcaatagatgtgacaccgaagccatcagagggactaccagcgttgaagattccatcttctcccccattaccaatagcaacagtacaagggactcctttttcaacgattcgggaaacagcgaccgaaagaacatcctgggaccatcccctagattcaccgagagaagcggtgataatgtcggctccagcatcataagcctggttgaagccagccatgattacatcgtcggcggaagtcccatcgcaaccgaaaactcgataggaacccagctcaactccaggggcggccccagtgaagccgtattgattctcttgagcagcaataatgcccgccacatgagttccatggcctacacaatccattggatcatcatcaggtgtaggatcatttgtaccggtgtaatcatctccaacaagatcagcgccaaaagacactaaacaattgggaccgaaacatcctcccagagcaggatgattatagtcaatctaaacagacaacacgcgtcagtaagccaccagtgaaagaagcagtattagtctggttttccttacaccactgtccaccaccgcaatcttgatcccttgtccagtatagccttcgtctcgtagcttatccacttgggtcatgacatgaggcgggaactcatcgctctttctaccacgcttttcgttgtagagtgtataactctgtcccacagtgccctgccattcaacgtgcggctttgcactctggcgcattttgacaggccacatccccttcacgacaggaagtttcgccaaatcatttgctatcctttttgcatcggccaagttgtggagctggattgaagcaccttgaaacagcgtataattaagcttcattcttgttatgccatttgcagctacttgattgtagaattccgatcggtcctataacttatatcagttttaccataaacaacataaaaaaagacgcacacacagaggagaggaagaaaacagagtgttaggggagctgtatgtaaaatcaaaacagaccgagttgaaaaacatatctgatcattgaactcaaacgtgtaagcacctggaagatgcttattgtctgcatcgtccctatgctcgtgacaaaacgcgggcgacaatagcgccagtaacgaagagacggcactgagacgaaccatcttgaccacctcgcaatgatacttggatgaaaagtataagaacagtggcctagctagcttagcaattaggtcacgtgatctagccattcaacaactaggcttatctttatcttctctaggagaaatcactcttaatctctcttaaataatatttataactaatactctataaataaattaattaaaattataaaaaaattagaattaaatagtatatatatatatttatttattaaaaatttataaaaaatttattttatattactagctataaatatctagaatttaagatttcactctagggtaggctatggggtaatctgatcccaggaatttgaaatggcaacattgcagtgttttttgctatataccgccctatcaccatgagggccatttttagactagcttaggaatatatggaagacggtacaaacactgtgttagccacatgcaggccaatattacaatgctacttaaagagaaaaaaaacggacactcatttcggtcaaccctgtaagagcgctgaacccgaccttgaaatctctcgaaatctcattatttatcttctttataacttttgaaatacttgacagccgcttgccggagatttaggccgttggcggatgtctggtgttgcaaaccccacttcagacgtcatcgtcgtgatgggacacgaaccggatgttccgggcgggggatatcatcgtcccctgcgtaaaagaaccagaacgacgagggcattggaatccgagcagcaaaaaggtggcatggcatggcaggaagaagagagcagtgaggggactcccagtcatgtccgaactaaggaacggtccatgcctaaggcaactggcagcgtgatggaggcaatccagggccagaagcaactcttacaacaagactttgataagaaaatggaaacgatgaaggcagagtttcagcttgagtttaaaaagctcagtgaccgcatggctgaggaggtcgctaggtccacggcccaggtggcacaagagttatcgcaagtccgagaacaacttacccaggtttgtagcgagctggagcagacccggttacggctggacaccttgaccaatactcacgcaacacgatcgcccagccagacatatgcagatgttgccagaatgacaccagtcagtattaccagccaaacttcgtccaccgtgggatcggcaaccccggaaccggtattctgcacagtagacacatccaaggtgccggaggaccacatcggtgacgctacaccagcagtgcttcgtaagaccatcgaacaggaaatgcgaatgtctagcaaccaacctagttggcgatgtgttgcagtaaccagagatgggcgaaatgctaaccgactgagggtcgtcggtagggacgaggaagaagtgaagaagataaagaccatcattgaggccaagaaggctccaggtgctcgagttcttcgggaccaactgtaccctgtcaaagttgacaacattaaccgcactgctatcctcgaccaagaaggcaaggtccttcctggggcaatggaaacgttgagccaggagaatgaagtccagattgctaagatggcctggttgagtcgaaaagaaagtgcaaaggcatatggatccatggtagtatacctcaccaaaaacagcgatgctatgagactcttacaggaacactacttccttgcagccggtgaatcggcatacactagcgccttcgagcggcgaaccggaccgatgcaatgctataactgccaagagctcggccataaggcattctcatgcaacaagaatcgagtatgtgcaagatgcgccgccgagggccatcatcatagtgagtgccagacgcaggttcctaagtgtgtgccctgcggtgggccgcatgagtcgttcagtcgaaactgcccgaaactctaccctaggcgacatgagtaagatgtttcaggtgactcaactgaatgtgagaaaacaggatatggtgcacgagagcctaatgaacgatgagcaactccaagattttgcagttatagcgatccaagaaccacaagcacggcaaaaggatggaaaactactaacagtccctatgggccatcctagatggatcaaactagtcccttcggttcggagggacagcagatgggcgatccggagcatgctgtgggtgagtaaggatgttgatgcagagcaggtaccaatcgaatcacccgacatggcagctgccatcgtacatctcccggaacgtttgatcttgatagtatcgacttacgtaccaggaggagacgttcaggccctacgagacacctgtaacattctacgccagatcatcacagatacaagaaggaagacgggtagggttgtagatgtggtggtggttggggacttcaaccggcatgatcagttatggggaggagatgatgtctccttggcgaggcaaggagaagcggatcagatcattgaccttatgcatgaactggacctcactagcttgcttcctagaggaacaaagacgtggagtggcggagactttgaaaccacggtcgacctggtcttggcctcagaaggcctgacagcatcaaccgtcaagtgcgaaatccatcagacagaccatggatcggatcatcgaacaattaatacgatctttgatatttcaatgcccagctcaaaagaacaaaatcgactactcctgaagaacgcaccttggaaagagatcaatgcaaggattgaacatgcgctggggccaattccattggaaggcacagtgcaggggaacacagacaaactgatgtcggtggtcctagacacagtccagtccctgacccccagagccaagccatcgcggtatgccaaacgatggtggacaactgacttaacacagcttcgtcatatatacacacactggaggaaccgagcccgaaccatgaggcgatcgggaggagccagttcggagcttgaagagatggcaaaaggagccgcaaagcagtaccatgatgccattcgacagcaaaagaagatgcactggagcgagtttctagcggacaataataatatctggaaggcagcgaagtatttgaaatccggagatgatgccgcatttggcaaagtaccacagttgcgcaaggcagatgggtcaactactgctaacaatggggaacaagccgaagagttattatcacaattctttcctctcccgccgaaggagattgaagacgaaggcgctaaacctcagagagcccctgtgacgatgcctgagctcacactggaagaggtggaacgtcaactattcgcagcaaagtcatggaaggcgcctggggaggatggccttccggcgatcgtttggaaacaggtatggccagtggtcaagcattgggtagttgctatctttcgggcatccttggaagagggaacgctgcctgaccagtggaggcatgcaaagatcatcccgcttaaaaaacctaataaagaagactacacgatagcaggagcgtggcggccaatctcattgcttgccacccttggcaaggtattggagtcagtgatagcagaaagaatctcacatgctgtggaaacgtatggtttgctcccgacgaaccactttggagctcgcaaacagcgatcagcagaacaggctcttctacttttgcaagaacagattcatatcgcttggcgacgtcatctagttgtaagcctcgtcagtttcgatgtcaaaggagtttacaatggagtatgcaaggaaaggcttcttcagagaatgaaagcacgcggtatccctgagaagttacttcgatgggtggaagcattttgctccaaccgcacggctacaattcagattaacggcacttcatcagaggtgcgacagctaccacaagctggccttccccaaggatcgcctctatccccaatcctattccttttcttcaatgcggatttggtgcagcgacggattgacagcaacaagggagccatcgcatttgtggatgatttcacagcctgggttgcaggcccaactgcacatagcaaccgcgagaaggtcgaatcaatcattgcagacgcattggcttgggaaaggaggagcggtgcgacattcgaggcaagcaagacagcaatcatacacttcaccaggaagaactacaaatgcgactctgaaccgtttaccatcaagggacagatagtccaaccaaaacgccatgtcaagattcttggaatcatcatggatgccgagctcaagtacaaagaacatattgcaatggcagcttccaaaggattggtagcagcgatggagctgaagaggctaagaggcctatctccagcaatagcaagacaactattcacagccaccgtggccccactggtagattatgcttccaatgtgtggatgcataggtttatatacagactcatgggaccgatcaacagagtgcaaagagcaggagcacaggccatcattgggacatttagtaccgtggcgacaagcgtggcagaagcggaagctcatattgttccggctcggcaacggttctggaagagggcaattaagaaacgtatggggttcttgaagaatacttagaacggccgaatgcgacgctggtgatggctgtggagttttgcgggctgatgctttcactacaatcctgcgagtatgagatatcattcagaatctcaaactgggatacgcatttggactatacgaacatggaaggaagaaattctcgaaaagatagtcagcgaagttgtgaatggaatcccggaggacagcttccgtattgggattggaaaggtcgattggatgagcatcgaaattatcgtatactggggttccagccgactcgaaaaatgcaagtaagaagtttcccttagattcctcggtacgagcgtattcgtacgtcagtcgtactagtttgacgcgatcatatctcttatctcttggctgttggttggtgccttggtcaaaatgatcaatcagctccgcaaactttcgagcagctgcttgatgctgtgccgcacttaggggcggtctggttgagaaatctagaattccctcgagggacgactggtgacgatgaagcggctctgcgggcattgtgatatggtgaagatggaaagggtgaagacgcaggcgtggggagatgagaaaagttgaagaccgggtacttaggccagtgccccagttcttggactgcgaacctgaaagatggctgagccgaagttgagccgacaacgttttgctgatgatccaaattagactaacctaatatggaaaatggagaagattgttttcaggaatgaactattacatagcttccggcgccccctacagaggcgccctgctgactaatttctgcacgcccccccaaaacagctgcagtcagtgggggctaccgtacatagcagtcaaatctgcgctaaattcccaattacctacctaccaacctccctacttgaatagaaagcctcctgttcctcaatatccctcgcagtcgcctcccagatatcatgcataccctttctactagagaaagggttgccttccatctcggccgcgacctgagcctcgacccgatcatcttctgccttgctccaatccggtagctatcgtaaccggcttcatgtaggcctctgtccactgtgactcttctcatcgccttccgacaccgcctggctccagcacgatcaggtcgcgctttgaggtccagaaacccgaattgtgttacacgctagcaaatataccagatgaaatctagcattggatttgagaagacctagtggtttaggcaatgctgaatttggcacaccaacaaccgccactttggtgcttcccatacttctactgtcgtatcgtctttatcgtttgaccattctattaaaatgtacgtgagactgcttctgtagttttccaccactttaggatcaatagcttgcaggaggagccgaaactggctgttatggggacaagccagaattgaccaaccttgttggactaagttccaactgtgagggagggtaacaaggcgtaagtacagcatggcgaagagtttaggtatgaggaataagcctggtggaagtttgtttgggttataggtagagatatgcgtcgtcaaagtcgtcaggggcattacatatggaaatcgtcaaaaaaaatgtacattgggcaatctcgaatcaccttcaacttaaatcaccatcagcttcctcccccaatagctgtacagcacccacatgtaggcccaagacatgattcttgtaccaaggccaaaagtcttcttttgaccactgggcgagacgtttgatcccagccaggacctgaaatgtgcccagtggtgtcgccgtgctcccaaacgtacgccgtgaccagagtttctattcggacctcagttagctcattgttgatccagtatccatgtgtcaacttaccgtcttccctccagtatttgtcgtgaggacaagactccactcgtggccactcaccacaattcctggaatgaatgggagtgcatctacaccaccgcgtgcttgatgagccaagagtctccactgggcggcttgccaaaccccaagctgaaattcagctttcttctcttgccctccataccgtttcgtctctatgctgacactgatcggtcgattttgtaacggctcgaaaccagtatggttggcagaaccatctgggagatcgcaccgcatttttcgaatagcttcggatgtcgccacgggatctgtgtcttggtctggtttgatgaccatagcataatcgactcgtgttcctggggcggctaggatcttccaggagggaagaatgttggcagtcatactacaagaaaacagttagcatatgttagacaaaacgagaagtcgaaactactaagcacctaccatggagtataaccaacaagttgcttaagcggccgagccaatgccatggtaagcagtggagagtgaacaagattattccagccactctcgtcttgttctgtttcttgacagtcttgggcgacattgacaatctcaagaacatcctcgagcagccatctttgtgggaggctatcaagagcatccggagcataaacaaaatcccggaagcgagcatagagcagggatgccttcttctttttctcgccaatttcatctttcaagccccgagggacgactccctcaccactggcaattccttctatatccaccaccaacgcttgagcagcttcgggcaagccctcagcatcgccaagattaatggcggccctctcgattccggatggatcgagtgagaggaatgggaaccgcgaaaatgattttgaaggagaggatcgcccgctttcggttgtgctcgctgaacttgacatgttggaataactcgcgtccggctgatctcgaagggaaacgggagctcgcggggttcgttgattgtcaaagggatcgtctccaacggcaattgcaccggtcgccgccttgcgccttttaggcgaagtatcgcgttccggcattttattttcttcgtagtcgtagaagctgtcgccagatgctggcggagaagggatttgggggttggctgagctgcgcttgcgctttctcaaagaggcgctggctgaattatcgattggtttaacgatatcttcgagccagcgaatgatacggctgtcatcgtttcgcatgagggcggctgttgaaatcgtcaagtatacataggtgatgatggcgtccgactatattcatggcgcattgtttggaggcactttgttgctacagtaactacgcacgtcaagtgcatggcgcccctacagaggcgcccggcagctatgtgtgtggagggggcgcgcagaaattagtcagcagggcgcgccgggtctaaaagcgcgcccgggcgctgcccgtctagctgctccactacctccgccgtccgcttctcgaccgctccccttccgggcttaacctgctcgaccttatagcggcagttcagcttcgtcgtccggtcccgcaccattacggccgagtctaccagcatctcgctgcggaaccagtcctcgagcatcaccggcagcgtcgctgtcagtagcaccatcgggcacccatatcggtgcaagctccgcagctcgcccagcttggcacggtacccgacgtccatgatgattgtgtggtactcgtcgataaatatccgctgtagcagcccggcgcacagcagcccatccgcatagcccgaaaactcagcgctggatatcacatccgcgctcacgaccaccagccgtactgctcgtagcatgccctcccgtccggagtacatcgatgccctgtaccggatgcagtcgacgcctgtcaccctcgctcgcatcaccaagtcgtccataagcgcgacgaacggcaccacgactatgctcgtccccgtatctcgcatcaccgccggcagcatgaacagtatgctcttcccagcccctgttgctagcacgctgatgaccgcctgcccgttcttcaacaacatgatcgaccgcatgctctcggcctgcttatccgatcgccaagcgccatccggcccaaatagcgtctgcagcccgtctgctatatcattctcggtactctgctgtccctccatactctgccgtcctgctcccttcccagtccttgtacgcttgcgcctagttaccagagctgcgccatcaacagcgttctgcttgtccggtactcgaccctttcgcttgcgtacttgcgataccttgtcctccgcgctgctcccctccagaaactggtaccacagcttgctgatctccttgaatattgcaatcatttccggctgcagcttccccgggaagccgatgtggacagcatagtgctgcctcgcgatccgggtcccgtacgttgactgcagatcccacacaatattccagctccccccgcagtcgatcggctcgcctgtgatcggatcgacctcgacgttatcatcatcgtcgccgtcctccatctgtccctcgatctgcctcatcactagccctcggatccggcgtcctatctcgatcgccaccgcccgatacctgcccaccccgatcctaacccccgtgccagcctgcatcacacgcgcgagcttcctgcttagctgttcggtatcccacacccgcgagctgccatccctccacatgtattccagctgctcaccacgtggctcggcgagcttgcactcccgccgcagcatccgttcggccgggatcaaccacgatatatatactactatcatctgcccgatcccatcgggtacgaaccgtactaccttgcggccgttgtcgcggatcgccttcatcttgtctcggtccgtaacaatcatgacctgcccgtccatgacgaatacgttccgtatcagctgccacgagtcacagtgccgcatcgtcgtcagttccggtcccctacccgggagcccgccccatgtatgcacgagcagcataagcatctcgcggagcagtcgcaagcgtcggagccacttgacgacgccttgtcgcttccaccggctacgcgcggaatcccaaatggacgtctctatcaacctcatcacctttgcgggcccggccttcagccacctattcctcgggtcggttgcgaataattgacccgccccaagccgcaccatgctgtcagcaatgcgattcatatcgaccgctcggctgaccgtctcccacatccctccgaacagtccatccagcagcttatgtacctctgtgatctggtcgcggagcgtacgtgtgaagctctcgatgctgatctgctcccccatgtgtactaccgcctctccgtcgtcagcccatcgtattaacgcctgcccgcccatattattacgccaacctttgccatatgccatccacccgataatcgtgctcacgacagtatgcgtaccagtgcacatccataccgtgtactgttctcggaatactagtacagtatcgatactaacctcgtcttaatctcggggctgattctcgaacattgactccaaaaaaaacaaccagccccaccaaagcaccaccgcgagcatccctgtatacaagtgcggctccgtatagccaagcggtcgttatcagatgcccagcgctgtacagaagctcagcagcgcgttcatatacacatttccgccgacatgagccttaaccgaagcagaaataaataaaaaaacagccctatcaagtgcactgtgcggcagagcggccacatcctcatcatccacctctctctcaccactgtcatcatcctcatcgctgccgacctcgccgtctctctcgtccacttccctctccctaccactacagaagccgctgtcataactgctggaaaatgccaccccctccagctctcccgcgacatcgcatagcaagctccactgctcgtcggtgaagcggacagcccagcgctcgtacgcctcctcgcgcccgatgcgatgtgccctccagcagaagctcaagtagcggtgaccaacggaccggtacttactcatcgacgcctccttgcccttgcgaccaaacggcacaccgctcgggttcgccgccgtgatgctgccgagccactggagcgtctccgtcggcacactgtcgagccgccagcagcagcagtccacctcgcggtcgaagctctgcccgagtcggctcaacaataccctttcacgggctgcttgctcatcctctacctgttgggccctcccggctattggtgccttcgcccttatccactcagctgcttgataaatgctcagcaagtcgcgggagccaaagtgccttacccagcccagcctcttgacccatgatgaatcacggtcgatatcctcttccaaatcgcccaaccggagcctcatggcatcctctgccttgagctgcgcttcactgttagcaatcatactctccatagcgctaataccgccgttgtcagacgcaactatgctgccaccgtcgttgttattgccattgctatcatcctctcggaccgtccagtaccgcgcgtacttcccccccatccacgtctgcagccggacctccgtccaccgaaactctgctctaccgtgctgtgcttctctccagtggcggacaatgttatctcgtgctactgttagatatcggcaagcgttgtagctgtatccgcttagcacggggagtagtttaatagctataccgccatccgctgggagtatatccttttctgggtcggctaagtccatgccagtatagtagttattaatatctctgagcgtgttacctgttaattgatatacctgtcggaagtgcttctcaaaagtattcggctgtagtacggtattacatttacagcaaataagcatctggtgctcctcatcaagctggatatactcgttcatactatatactagtaatacttgaatactgacttatagtagtaataatagaatataactaaatagtaagtactattcttcttccttcctatatatatctattacctgcccccttttcctctctacccctgtaaccctatattgtaaccctgcgtaaccctgcgtaaccctgcgtaaccctaaccccaagttacccataaccctggagcgctgaccaatcagcgactcagcccagcggcaaacgattctgcggaaatgaaactaccccgcttacccatttgtatggacgattctggcagaatcgcctgtgaataatacctagggtgcggtatgtagttgaggtattgctgtgtacgtggttagttgacgcgttcgaagaaatttgattttttgattttttttattttttttatttttttttgctcgctcccactgaagtaggtcggaggatgtgcggggggttgctgtgcgttcccactgaagtaggtcggaggatgtgcggggggttgctgtgcgttcccactgaagtaggtcgcgtgtgtgtggggccgcgtggccatggaatgcgccccggattctcggggtgcgccaggtttggtgtcactacaaacccggccaaaacagcgaaaaacggctatttcgcgagaaaaaaagtaggtgcgattgtgtggatgcactcaccgatgcaggaaatggggtcagaatacggccgcgggcgcggcgcggggagaaatggctgttttcgtgctcgtagggcgattggcgtggatgtgttgaggtcgagcttcttaggctagaggccggggagggatttctgcaggagtgcacgggtgggtcctgcgggccggaagaacctttatccgggagggcgcctcacccacttcagtgggagcgcgtcaaattttctcttcgccgaagcgcgttgccagaaagggtattatcagagagcggcaatagcagagcgtgcctctctgtataacgtgagggtaggtttagctcacctacttcagtgggagcgagttgagatgtgattgttacgtgtggccggggtattgtccaaaatggacaatagtagagcgtgcctctctgtataacgtgagggtaggtttggctcacctacttcagtgggagtgcgtcgaagtttgattgttacgtgtggccggggtattgttcgaaatggacaatagtgatgtgaatttttgtatgatgcaagtataagatcatatgagtgtagtatggccggtgaatggcagctcgccgtagtagtctctgtcgtcgaggaggtctgaataggctcatctcgcccgttactgggtggatggcgtgtgaactgtcagtgggtgttattataatctttctcgtggtaaggggggtggtgttagaagttgagtataaattgtcctgcagggtgccctctgtatcctgcccttcttacacctggctagccaccctcgcacggtattaccacaacgctcatacagcccaagtactacactgcaatctatccgacgatcccgcatactctgctgttttccggtaggcaggtcgtcgatctcgtcctggtgtctctttgctgactctttaggtactccacctgtcgaggttcgcagagatgccggcttccgacgaggtcccggtagaccgctcgggcgatgatgcctcgttgtactctgaagatggtgtccacggcaatgtcagcgatgcgccacctgccgaggaaccacctgccgatgacgcggatgcgggtcggtccgctggcctctccgtgcagggcgccttcgataccctggctgcatacatcgtgggcctgcattcactggtcgaagtgtgcgcggaatggtcggaggaggagagggcgggggggcaccctaagatggaagcccgcgtcagcctcatcggtgacctggagacgacggcccggctgctgcgtgagcagtgcgcggtgacgcaggttgctgttctcttctcgggccctcgcgggcgggttgtggatgcgaatgggcctctgctggccaacctccggtcgaagatcgccgagctcgggctcttcgtcgacgcatcgcgccgcatcctggcaagcgcggcctgagtctctacttgaccgagttggtacactgcgaggtttggggtatggaggtatactgcgggatgttctggagcctccgaggctgacacattaccgagaagattcgctctgctggccctgaggggctggggcaggcttactattgtactgtatagattgctctctgataatgagactacattgcaacccccccggctgtctggtgtgctattgatatgggaggttggttcgcggccggggaaggtatttagatcatccggcctggcctgcccggagcacttcggtgggagcaggtccgattctccgcggttttgcgttttcccgtggtgttgggggtcattctactgtatgtctagtagctgttgggatcctcgctgttgaggctcgaaaagtgaatccacctaagagtgaatccactctgggtgggtaactttagatggattcacttcttctgcacttgtatgcagagtgggtgacgtgattactgtgtaaggattagtgtattcattggttctcttgtatatgattggatgggctggtaccagttcatggtgcttgttccattgtcggtaaggtctgaatagcctcgccttgtctgctgcctattgaatggaagtgaacaataggccggtattatgggggtccttccggcattgcgtagtagtgttggactttgagtgtaacctcttctttgtggaatttttcctctgccttcttcccctctacataaccagctatcttctcatgatagtaaagcaggtgggatacagtaccctcatctcatctcagtacagactcgtcttatctcgacacggacacatcgcatatcctgctgctaccttgtaagtagcttctggagcctgtctcgtcaggtccttgctgactgggtttgcagctatctcttctgacgcttgccaagaggtcaggccccgacggaaggagtatggatcaacctgccgaggatggccctgccgcgctgcccgccgaaggtatgtctccgcctgccggtctcgcggatccctggcctcctgctgatgcagatgcagatgcgggcatctttgccggcttctccgtggacgaggcgtcggatacactggatgcctacatcataggcctggggtgtatgctcgacgtgcttaccgaatggtctggggaggagaggacgggtgggcaccctaagatggaagcccgacttggtctcatcgagggcctggaacagaccatgcgcctcctgtacgagcattgcgaagccacccagctcgttattctcttctcaggcccgccggatgcggttgtcgagtcgaatgggtatcgcatgggccgcctccggtcgcagattgctgctcttggggcttttgtggagtcgacgcgccgcgtgcttcatgatggggtctgataccgcgccgtctgaggcacagacctggaccacgggagactctaggactttgggaactgatgctcgatgtaattactctgctggccctaaggggtcagagtagcctgccatgcgctgatatgcatcttgctcgtttgtagtagatacttgctctggggatgctttcgtggaatgaagctcggatcctgcttggtttcgctcttgtaagctttgtatcgggtactagtctgatgttcgggtgggactgggtggttcttcttgcctggttgatcttggtcagttatactgcggccgggattgcggtatattgctgtatccgtaatgcctctgtactgctcgggaggttacatccggctgctgctgtgactgggggtatgctcggggggtatggattctgccccagcggctacttgctatatagtgtggtcaggatctctttgtttacaaccctcgccatccaacttcctcccttctcccactgaagtcagtcggggatgacccgaccgacttcggtggggagcgagcaaacctcgggagattctttcttcggcgcagggtacggatagaatgcagagggtgtattatctatggtatgttaggctgtggtgctcttggttttcttccgggatggatttattttcttcctctgcagtatgctttacccccctcttttatatgggtgaagcgcgacgtgttaccccgtatgtacgcggcttgatgctttgccggggtagtgtggcgtcttaatctgctgcccctttgtatactgtagataagtcttggtatactgccttttccagtagggtgagtttcttggtagatcctgtacgggataataggtatggtaatattggatttggccggttagtatgctggaccgtgatattagtatctggtatatttttatccatcgagtccctgtacatattctcgatcccagtattccgactgactctaatctactggcctctttatagctgcggtctatttcggactgaattcgctgggggcggattgaaattatgattcatctttgctaattggtcttgcatttatttgctgcatctcttcccttgttttactatggtttatattgtagtctggctgctgttatagggtaggtagtatatctggtgagaagatttctaagatgagtcatccgagtgggggtgtttgagttttccaatggctatatagttgagtatttggtagggggctatctgttcaatctatctacctgttcgttgctgctattctactggtatggatgttggatcatacctggttctgctggctggtactgttattgatttgtattctgtggattgttattggtatgacctggtgcttgggctgctggtagagcctgtccctgtctccgtctccggcgctgggttatccagtctgttctccagtcatgtttccgggcttctcttgtcactcgtcgatggtgggttgtttgttggtataatgtatcgctgctgggtgtacgcatggatatctgggtatcgggggttgcggtctgggtcggcgaggaggggggggtaaggttgggctgcggccggttgggttgtatatcttggttgtgctggttcggtgtcggtgtgccctttggttggcgggtggtatatacttgtacaatcttactgaaaagacgatctaggtcctgtgctgacctgtcctttatatgactgaccatgttgatctcgaagggccggccctcctcgaataccggattaaagctgttctggttagacccgctgcggtggaatggcactgtcataagacgcccgaatataagatcttcggccttgatcgatggtctgtcgggttggctgtggcggagctgctccaggagccacgagggtgtggatccggtgatgctgtcggctggcatgtcgtgtgtatttctgtcgagtctgtattgctctcggagaccggcatgcgcctggccgaacccgaataggcccatcttgtggctgtcgtcctctgggctgttacttgcgtcctcgtaaaagtacgacttttggttcgagaggcctgcttctccaggtgcggagatgatggagacgaagtgctacatgctgtacatcttgggcgtggtattttggttagccttggacttggtaatcatcatactatcgctgggccacggcaggatccagttcgtggccaggacgagccggcagaggtcattataccaggcagcagcctcctctgcatctatggactcggtaatcatcatcatggccgaggccgtcgcgaccctgtagggcttggagttccaccccttgcgcgtctcgatcgggtctttgtatgcccaggcccgcgccggtcgctggttcgggggtgcgaagaggtcgtcgaccagttccagcggctcctttgtccgcatcttgttccccgcaacaatgtatgggtatgtacgggttcggttggtctggcggttgtggaagagctccttcatatcatcgtagaataggcccggcgggttgcgccgtgcattaaatatctatagtataaattctaaaagtatttaattcttaattttattaaatacttcttactatttattattctattaaaattctattttttttttagtaatattatataaagatataataattttcctataattcttaataaattattaatagtaattagtaaatttaagaaagatttatactttcttaatagtttttaatattttctatttcttaactataataattatattttattttatttatattttatttaattaaatagtatatcctaagaagttaactttttatatatagaaataacttttctttagttctattaagagttttatatcttctagtttttctaaaactttatatatatattccttatatatttctagattatttaaaaagattaaaatattattaaaatatataattataaagatattaaaatacttctagagtacttaattaattatttattaaaatattataaatatatttattagtctaaagagtattataagatatttataaaagctaaactttattctaaatattattttctatttattatcttccttaatttatattaaattataagctttctttagatctaatactataaactattattttctctataattagtctctaaattctataattagtagtaaaagtattttatctttatatataatcttatttagctattagtaattaataactaaatagagtttattattctttttagatataaatattatagagtattctatagataaagttaatagctatatatagctctttactaatatattattaatatatttatagagtatttataactagagttctataaggttatagagtttataaaaagctagctcttcttttttaataatagagattttataattctattagttatatttagatagattagttttaagagtttctttaaatagtttattataaattttatattcttctagaatattctttagctattcttcttcttctagatatcttacttagatatatttatattagatattattttctttattctattatactttctattagttatttattcagttctatttttagattttaatattaaatagttctaaaagtagcttttctatctctttttactattaactatatttaactttatatttctattattattcctttattagctattcctaattaattagtactaagagtatatttaaaagctatacttatttttatatttaatctaaaatctatattatttatcttagttcttattataataagttttttatagttctagattataatattattaaaactataattactatatctatttattattataagttattattattttttataataatacttttagatattaaaaaataaatatatttttctaatatctaataaaattttaatttttattaattctaattttaatacttagaagagttctactactctatatagttaatatactaattaatcagtaggtttatatcttatagctatagtagccctaatataatattataaccttctaatagtactaagttatagataatattaaatttcttttcttagattttaattataagataattagtttttaaattaataattctattattatatttaaactttaaactttttatattagttattatatagatttctttcttcttcctctatagtaagtagagttagttaattactactagtaagatataattttcctatactctatagttaataaatactagaaactagtttctcttaatctttatttctataaggatataaatagagcttctagcttctattactcctagggttctctaatctattattaatattatactatactatagttttattatagatagtttagattattttttatctaattaacttattctttaagtatattatacttattattatattttaatatctattttaaaagttcttctagggttttaaatatatctatatatcctaggatatactattagaattttcttagctatctactaagtttattttattttttagaagatatagtttctctttagaagtaatctatagtttattcttatttatctatagagataatctttagttccttatcagatttcttatcttctattaataatactattatagcttatttttaatattaatattatatttctttctaagcttaatattatttaaatatctatttagtaaggtttttattattatccctatttctagctagattaaatactatttatttagtatataaatagtttaagtagttctagttataatattatttaatatactctttatagttataaatagcttagttttcttagatcttctatttatattataatttaatttttttattcttatagatcttatattattattcctagtatattttagctagtatattattagctttatattccttagagtacttttctagatcttatttgttgaatttgagagattatagccactataagttagtggggtcagatcgctgttagcgatcctgaccactagctgctagctatcgcaaccactagcctttagcgattgcagccactggctacagtcgctaataacctcctgccaacgctagccaatagcgattgagatcgctatccgatagtgattacgatcactaaccaatagcggctgcagccactgtgggtcagtggctacagcccgctatgaccgctacggcctagcgggccctaggaaccctcaggggtccgggccaccagcagagctattattaggttatcgggcttatctagcccagatccccccaaaaaaaaagaaccatcaggccatcctttcgtgacttacgtcctaacccgcaacccgaagcccaacctcgatctaccactgcatcaaggacatcgtgtcttcacctggaaaggagtcaggccgccttacctcaaagagccaaagcctttatacccattcatccaaaaatgcttttgtacatgacgctgccgttgctgctgcataccgctgaaatgcctttgtcttgtggctgtctgcatagtcgcaggcgctctttatcacgatgcagggaacaatttcccaaacaccggtgccttccatttcgaggcccagaatgccttcctgtttagccaatgcgtctcgatgtgccccagacttcatcaccttatctcctgaggcgaataagccaatatgaaccgcgggcttcggtgtcccgctgataagacgattgcgtggcactgtttgaccgcaacagcccgcctctttgcatggtagagccctgtcctggtgttcatatttcgtgtcgaaaagaatgtccagatttgtccccggatggtatgcttctaatttaggtaactgttggagtgtgttaagataaccatgcatcttgtcatgaagcgtggcttttcctttgtctgttttaagcttcgctaggaagttggcgatctggttgttgggtcttggaagcgagtccaaaagagtgacctttgattcgaatgactttgtgaattgtcgtccaaaatcatactgaacgataccctcacccacgatgacatcacccaagatgatttcgttacgacccggtggaagaggtaccgcaccgcagatacccacgacaacagcaagcttgatgttgggaaatgttgccttacaactcgacgcggctgaagcagcgtggacttttcccatgcggcccatatgaataagaacgatgttgtgccggcccaaggagccagtggaataggcgttgtcatccctatcagatttgtgatagcagggatcatcaccgccccaggagtgatcgaaaagagcctttatggcgtccgcctcgaggggaagggcgcaaaatatagcaatctcaaagtcctccccgctggtaggagacctcggtccctctcgttgtggggagatggcgtgcttgctgccgttatcgctggcatgatctagctctgggtttatatccgcggcaactgggacacacttattcaccgggccatgactgccagatgcaagcgcagatccaagtggcttgttgtctattgtcgggaacagtctagccgggtacccaagtactgccaccacccgctgatgtagccattttctccggctgagatcggacattgaagtgttcaaatctgccttgaactctagacagtttctgatggctctgacgaaggcctctaggtattgagaattgatgtcccatttattgttttcaagttcttttagtttctttaaggcatccatgtgacgcttgttgagccgctggttctgagagtcggacgatggtgtgcaaagaggttcaccgagtccaatttccaggagcaatattccgagagactgaatacgaggatacttatgtatgagttgtcttctattaatacactcagaggcatcgccatcgcattcagtcgcatccggatggaaagagacgtaggctttgagtggcacttttttgggttcgcgttgtccatcttcctgtggcatgaaccatattgtgtcgctgctccatactcgatacatgagttcagagctgtagaactgccagaaagacaacgctatgatataagcgagtgcgaacttttctctgatagtaagcttgaactggcccaagacactcgacaaagacataccgctaccaggggatggtttatgtatcaatacttctgctctcgaccagaaaagatctctgccatggagcctcaaagaaacacgacatccattattgtcctgaaaaatcttgcagaatgagtcaagtggcgtatcgtccaagccagtcgagtcgcgagatgtgcgatccggccccttttcgttcgcaaacctcacccgagatttgttaggctgaagaattgagggctgagtactactaccaacacacgctggtatctcaatacagaggtcttcccaagacccattgatagttgacgatgtaatgacatcaaaccggacgagatcttccttgctcttgagcttcatcaagaataatctcgctggatgccatgatggcgggtcttttgcatcttggtgcttgcaaataccacagggggtgtattttgcaagtgcctgaaacaatgccttctgggcagcagcatgatcctcggactcggtttcctcgcagtctctttcccagccatcttttggaaaaaaatcgatgattctttgtttcaagatttcaaggatgtcgtcaggctctttcaggtaattgaagatacttttggtcagacgttctgcctgcgagttagaatcattcctggccccgtcttggttaagttctttgcgcctttcgtttttgactaggatccagaggcctggaaagcgatccttcatcggctgttccggtgaccttaatttgcccttggtttggatctgtagcttgaatatagttagcgaaatagcctacacaatataggcgaagatataaaggattggacagaggcttactacacacatgtcatctaggacctccaagagacggtctactcgtttatagaaattctcgttcgagtcaagccccacgacttctttgagaccagtcttgattgctgctaagtttgttgcaatgctcaagcatttgccacataggtggctatcttccgtagcctggggagaccgggaactgtgcgggcactcggagagttctcttatcaccagactgaccttgtcggcgcaaatttcgagccagtcaattgcctcttcttcgttagttacaacacgggctgtgtcgacaatcggctgtgagtgtgacatgcgcggacagctcccctctttctctgcccacggggatgacaatctcgaacttctcgctgcgatcatccggtccagctgttctctcaacgggaagggtttcgctggcatttcttcgggctcgcccttcaatcctgggccgaaaaggcgacgctgaagcttcgccagccgtcccatttggagaaacgattgtgggcgtagggatttggcagctccaaaagcagcaaaaactttcagaatgtggccgtatttggtcgcgcggtgacagtgtcaactctttcccctcaaatcagcagctcagcctgataatgaggcagactgggcggggttcagcaactcctcagaacttttgtcatctgctgtatatcagattactatagaccagtcattccaagtgaaaattgtggggcttcgcttgattatgctcctgtagacgaataagacctatcacccacccttcgttggtgcccgaatttcccctcctcatttcttcaaacaacggcgtatcttaatttgatgatggatttgtcaacgcagtctgctgcaaatctcgctgaacagtgcatcgaacgatttgaccagactctcgagataccaggtctcgcgaacaatcaatgggccgaaaatcgacgagcagacttcaacctttgggtggatggtgttggagcacgggcgaggcagcgcgcctctctcgatagcagactcgaatcaaggcaggacgatttagctcttatcaagaccattctttttaatttgaaaagctatctaggacgttgtctgacagttgcagagggcaattcgttaagagaagcaaagctggatgtcgacgccgctattgacaaccttgctctaattgccgtggcaattcgccggagtggacaaagatctcgtcttttgaaggccgacaggtcctttgatcgtaccgctctggtagaactcgagatgcatttgacatgcatggctttgctcagacgaacttcgcccaaagaagagttcccaaagcaccatgaggacgaccctgcctggtggcagagcgagattgagggtgaacctactcctctgcaggaccgattgatcgaggccaatcttcggagacgaaaccgtttcctctatgctcaaagacactccaaaaagcttgcgatcccacaaacgccggcaaaggaactggttgccaatcgacctgttcctgatcgaaaagaggtctcgtctccggaacagattggagtcaaacatcgtcaagtgtcggataatgacgtgcgagagatgaaaaattctctggtattggcaccaatgtctttaacacgcgcatctgacatcgacagcaacttgaatctggaagagaggaagatcgcttttcaggcgtctaagacgcagataacttccataactggggcaactgagtaccctaagcttcgaaaactaccagtggaaaagtcgggtgaccgtgacattgaacaaacgaagctacacaaatgtccttgctgttgcgaggccctaccgcgtgcagcagtggcctccaggaatgcctggaagtgagtttcaacgatcctttcctatgttgttccattctcacctacaatagaaaacacctctctggagacgttcgcccgtacacttgtatttccaaagactgcccatcgccacttgtcttgtactcgacacgagcagaatgggaggatcatatgaaaaaagagcatccgaagaagtggaaatgccaactttgtgatagtgctgaaagttccctgttctctaaagttgacaagttagttgagcatgtgagacagaaacacatggattcgttcttagaggaagatctggaggcggtgccgctctggccatcaaccttcaccatcggactcgatacatgcccattgtgccgttcagcaggccccctcgatgatccaaccttggtcgaccacgttttggaacacacgcatgaatttgcgcttctttcactcccctgggcggacttgccaaccgaggggttgaccatttcggacttcttcgatttcgggtgcttgaaacctgtggaacctatttttttatcttctctgtctctgacctcttctcaaagcgacggccacagcagcgaggaagacggcctgttgcagagtaatgtggaaccttctacgacggcggagccagctattcaaacagtccagtcaccaatgcttacttggcttgacagactggatatgccagggcccgaggaacgggaagactcagtcgctgtattagacaaactcaaggattgccgcacagaaaacagcggcaataggagagacgaccactttgctaggagcccttacttcgcttccgactctgaggcctcaacacaagacgctcatttttctaggggcccttccttcgcgtccgagtctgacgcgccgacacaagactcacaaagagatggaagctcaggttctagcgcctgggctgaagaagaagaagttaccgaagttcgtgagattcgggaccatggagaggagcttcattatgacgatttcccgccacaacgtcgccgaattccagaccctgagaaatggactcaggtcgacgatctgatccgcgaaattcggctggcattgaatgcagcaaaactacggtaccagtttgacgcctctaattattttgtccctcgaagtaaatttgccgagattatgaagcctcaaaaggttctcgaacttgtccacgggttggagtgcttccaagacaagtctaataagcaaaagcaacaaattgcccaggatatctgtttcggctcaattaaccaacgcccttcgcttaaggtactcggcgccttggttgccagcaatcaagtgggtgaccttgcccgacacatccagaatggcctaactgacggctgcctaccattaagacaatatggcgacaacaagttctatcattgctggcaatgctctgacttaaaccataccgccgcgatgaacgatccaaatgcctctgccgatgatcgggaaacatttgcccaatggactaagaaacttatacctccttatattaggtatcaactaggtctaggtttacattgccattacatattcgagaatggcaactgccttcctattgaatacagcgaggaaattatccctggccagagcgattcggggtcgcagtctggaaatggcagttatgaaggcttcggcgaagtttccagggtcaagatccacgattcccatcacagtcttgaagacaacggggtacgttttttcccgcgctatctccccctcacaagatgcttccgttctcaccttggcactccagatgcgaaattctcgagggtactacgcgcttaaaaagttgacgtctcacgaccgaaaggatttcgagtcagagctttccacattgctcttgaaagcggaccacaatcgtagtagggagcacatgattcaattacttgcaacatttgaagaggtgaaccctggggaccgtcagtctactttttatctgctctttgattttgctgaagggaacttggaggatttttggcaatcgaatgaacccctggttcaagacaagtctcactgcctctggatggctgagcagtttcttgggctgggtaaggcacttgagattgtccataatggccgtcgaaggttgcgattgccccataatgtcgtcgattccaaaagtcacggcgactggcacggaaatatcaagcccagcagcattctcttttttaagccccaaggagcgaagccacatcttgccttcacagactttggtcttggaaaacctcacataaaggtctctcgctctaggcaggatcccgaaaaactgggtcgaacagcaacataccggtcaccagagtttgatcttcccggcgggttggtggggccgagatccgatgtgtacagcctcggctgtgtctttctggagtacatcacctggtttctgcgtggccctgttctcgagaggttttcagatgagagaatcgagacggatatctacggcttcgatgcagataccttcttcacaatcgagggcaatgaacagaatacagcggtgatcaagcctgcggtgaaacgctggattgagagtttgaaggaagaggaggcttgcagctggtacttgattcgcatgcttactctcatcgaaaccaagatgatgcaagtgaacaaggataagagaatcagcgcgagggctcttgtcaagaggctggaaatgctttggagaatttgtcagcggaccccttccttttataccgagaactggaaacagtaagtttgccctaggtggtgctgggcaatgaggtataacgtaaatacgtagaaggcgcacagcccgacaacacattgttaggcgatggcctagtacaagaaatttagccgtggctgagctaggcttgaactaatcagaataggtacaaagcattgcctttctatatcgcccaagagccatgatagaaaagtaatgactggaaagctgggatcgaaggtatacagaccccggggaatccgtgcacgtgaagtttgatttctcccaagatgccccatgcctcttcagagaggtatcttgctgctgggccaagagataatttatcccagctcttatcgagacatcatccggatccagttcttccagaaggcacataatggcccatgctgtctgagacggtgtggatgggccccttccagccatctgtcgatcattgcatgattcaaaaccctctccccatccgccatccaagttctggacttctttgatccaggagacagcggatgctatcatgtccttcacccagttgtcaccatcagcaaaccaagccaagccggagattacagcactggtaccataaagataactctcaccccagcgaccataccacccgccaaatccttcctgctccggggccaaataacgtactgccctctgtgatgcagtcgcgatcgctccaagtacttttgtctgagccagttgagagctcaggtcttcatagctcttctgcgaggctatgttgagaaccatgccgaacgcctcaagaacataacccgtaagatctgtcgtcgaactatggtgtaaagctttcaacggagtcttgttgagccactgcttgtagttattagtatcaaacgccccccaaccgccatcagaattttgcatctcgcaaatacacattgcggctctcgctaccttgtctggctcgagatttgaggagttctgatgtaacatggagagaagaaccgccacagtatcgtcaacatcgggcgtgagattgttatgatgctggaaagacaatcctcgtaagacttttggcggactgaagctgggccagcctccacgtatgttgggcatgtgatgcctactaagccaatctatggacttctgaagacgggcatcgtttttattccaccctgagtcgcagatagcacgggccatgagcgcaatatcccagaccggtgacacgcaagactgcagtcgtttgccggttttgtcctggcatatgaatttttggataccctccatgcccagctttatcacagtactatcctgtgaaaacccttccaatactaatgctaggatgttgttatgcatttggggggaaatccttagacagtcaccagatggctccaggttgttgagaatcgactgaacgcaatatctcagggctttctttcgcagaggaaagcgtctgagtcctagataggatagagctgtatctagtcccgagaaaaggagctcagcaggatcgatctcacggggtgcggaaagtgagaagtgagaagtcatcttgcgcgttggatcaacccatagctcatcaagaaaatcattggtgaccgacctcccgtttggaagagcgtaaataggtcgatggtgggtgatgaccaagagcggaattaatgtagaacgtgcccagggcgacagctgatggagattgaacttcaaagatggcgggagtagtatcaattcagtaggcaggtgaggaacagcgtcccaatgaaagaggccaaaccgtgcaaaggaaatccgcgtgagcattctgaccttggcaacaccgccagccttgagtataaactggcgcgcctttgtcatttcttggcacgacgcgctcatgcctagcattttgagggcaagataggcctcacagcttgctgagatgtctccatggcacttcgtagcaataggccaagaaccatcttccttttgctctgacagtatgtagcgcttgtagagctccgcatccgggatgggagttcttccaaggcattggagaagaaagacttgttctgcggttatggtaacgttgcaaagagcctcatctcgccagtgctcatcaagatgcatcttgtcccaggtgtagtccatggcaagggagagggattggttcacaagatgctctgggggccgagagaagtttctcgcctcttgactttgatcgaaatccatgattgctctcttcctcctctcttaatgcagaagatatctgttccaattagtgcgatgtcggataaatggtatgtgtagatttgatcgattgcgaagagatcggaacgtttgggacaggaagttccccgtcaccttcatatctacccatcccagacagaacatctgggctttccacatgggcatgggctcctttatgatacagatttaaatggttttcgacttcgcaaaaattgagctgcatttatcgtacatgtatgggtccaaaagtccaaatcctcccgttccggcgcttccatgagttgaacaagcgatgcatccgttctcgagtatttctaaacctgatttcgatactttagtcaggatacactcaaactttctgtttagcgccggcaaccatggtcaatttcaacggattggggggagacgtcatcgacaacttttcctcagtgatcagtgtctccaattgttacacatgggtaatcatggtatgtcatgaatcatggcatacatatgtatgtgcaggtgataagattgtccataaagagaattcatcgcagtggcacgtgttggagctcatcaagggatgatgaataatatgggggcaatccgaggaatgcccacgactaactcatttggctggtatgcaaacggtcaccaaactccaatttgtggagatactcgtgttactacccttgaaatcaatcccaactaagggctttccgttaatcacagctcatcgagggttgttctcgaagtttgagggctagaatcacccttgtgctccaacctcgaaaaccctggagcggcgaaattttcaatagatttcactgacaactgagtaaatgatataacctacacccgatataaaaagacgtgcttcggccgaggtagtaaattgtctgccctgttactggctttgtccaaaacaccaccaactgtgcacattcatgcatcaacgagccgagaaacggatatgagattcgagtataaagttaaaaatagtaattaaagatgccagaccagatatctcaacacaatgagagccgagaaacaaaatctcatacttgaatatcgaggtttgttgcgtcaagtttgtttgcagacgggaattgcagtgtcgcctctgatacccctggtcctttcgtctctgagtctataataagtactcacaacatcgcggttccttccttgtgaaatgacccatctgtacttgctaaatcgcacctccctaaacatagcacttctttcaaggggcgtagccttcaatttcccttgtacttctgtccgctaactgtgcttatccctgtctgtgattggcaaagtcttgatccttgactcgtaagggagatattttagtatctcaatcaaagacgggtagttcttgctgggtaaacaaagagtgaaaacatggtcaatttttgcatataattacctcccatacccccctacttagcacgagaaattcctcttgcgttcaacaccattacacctcaaagcactgcaaagcactgcaaagcaccgcaaagcaccatactgcaaaccgaccagacacagctctttcccaatttaccactacgacaacatttgaaaatggtcagcagtgtcggcgagtggaaggaatccgtcgaaaaggcaatcgacgatgctcaaactacagacggaggtggcatcgtcgaagcctgcgaacaaattgcgactctctcccatcaagtaaatgatgtggcttcgactcccctgacagacgatgaaaggaaacaatggaaaaaggacttcgagcggaagttcaaaatcctagacgatctctccaagaaacatgttgaccatctcaccgaccagaaccgcaaggctcgcaaaatagagctagcgggcgcaaagaagactttcaaaactgttatcaaattcttagactagattctgattacaaagattgcagagttcgatgcggatgggaacagaaaaagagccaagcctctgatgttagaaatttttgggtagtgggaaagtctcacatctcatgctttgcctgataggtagctgaataacattccaatttctcccaacaactcctcattcttgctgaattcgattgcaactatgatatatcgtagatattcaagaagccaatcgtattaatagctaataaaattcacattctgctgctcagcaattctttaaagttgggattcgagaagactgcataagaattggttcaacactattgattacatggctaaacttgcaggagatggcggtgtcgtgtctagacgtatcgagaagattcaaagtcagaaaaggtaacaatgtgtagttgttcatggaaattaatttaattaatgcgattggagttgtttcatgtcattatgtcattttgctctggtggggcatgtgcgtgttgtggccaatcagcgtcgtgagtgataatcggcatctcaggccctgatccaactctcgaagaagcgcaccgaaacactccgtcacaatcacaaccagaaccatcggttcctgctcctgactctcattactcagtccaactcatcgtctctcattcatcatcaaccgaaacaaaatgccttcatccagaatcatgccggtcgaggcgctgcccaagttcttgctcccacggctgagctggcaggccacctcgcccctgctggtctcgagccgatcctcgggccagcggcggcatcaacatactgcactggcaccgcgtctgcaagcatcgccgttccatgcccaccgcccggcagtgtcccaaagaaagcgcagccagatcattggcgcggcagctttccatgccacagcccgccgccagcgagaccaccacttcgacaccctgaaattcgtccagcgactccagagcgaagggttcaccgaggaccaggcagcatcgatgatgaaggtcctaaacgacgttattgaagagaggtacgtggcctagcattgaccctccccggagcgtcctccccttcccgaaactcaggctcacccaaatccaacccacagcatccaaaacctcacacggaccatggtcctgcgcgaagacgccgccaaggccacctacacccagaaggtcgacttcgccaagctccgctccgagctcctctcggcggacagcaccgagtcgaacacgacgcgcatcacgcacgagcggctggccaacgagatcgccaagctgtcgagccggctgcgggacgagatcgggcggacgcaggccagcgtgcggctggacctaaacctcgagaagggccggatacgggaggaggcggtcggccaggagctgaagctcaaggagacggagacgaggatcgagcaggaggtggcggcgctgcgggagaagctggagcaggtcaagttccagacgctgcagtggctgatgggcgtgtgcaccggatttgccgctctgcttcttggtgcttggaggctgctgatgtgagggatttgggtaggcaaggctggagtttgggatgtatatagatgtgtgacacgggcggggattggggcaataggggagtgcggcgtattcccaatttccattaattcgggatttgcgttgattgattgatggaagatgtcattgacatgaccgagtatttcatttgtcgttatacattataatcactacagacacacatatgccctcggagggcttaaacagaagacagacatatctactgcagggtttggagatcaaagcagctgggctgaatggccagcttttccagacaatatacatttcaactcatctcaaggaacattcgtccgtgaccctcgtcgagagtgggcgagcgagtaatgatgctgagggaccgctcaccagccgcagtagacgcacgtgtaaccatgatcagggaccgatgacggaatgcagatgcaaccccgcccccgcctaggatggattgcaggccagattcacatcgagcttccatcttggttggcaggggggctatcgctgggtcgcaaaacatccgagaagtggaattgtcatggaaccgcgcagatttacggtgccctcttagcctgctgccatcgtctggctccctctctcctctctcctctctccgcttcgtctgtacctgaattgcgtttgttgccagccaccaagttagccaaccttaaaacacacacacctttgctcatcatgacccgtccaaagatcctgctgctaggcgaaatagagcagtgagtttaccccgatgctaattgacttttaaaaaccacaactgactaacggcctgtcccgttcaccctcaccagcgcccacgacgcctggaaagccgtcaccgatgccgccgacgttatcgagcccaaggcgaccaacagagatgagttcctcgccgagtgtaagagcggcgccttcgacggcgtgtccgccatctaccgcactggcgagtcagccgccatcaccggcaatgtcgacgtcggcttcctagacgccctccccaagagcatcaagttcatctgccacagaggtaaacacccccccctcggttccctccaaagccaagacccagattgctaacgattaggggggtaaaacagccgccggctacgaccaaatcgacgtcgacgcctgcaccgcccgcgagatctgcgtctccaacgtccccacggccgtcaacgacgccaccgccgacacaaacatgttcctcatcctcggcgccctgcgcaacttccccgccggcatggccgccctgcggcgcggcgagtggcgcggcagcgacctggcgctcgggcacgacccgcgcggcaagatactgggtatcctgggcatgggcggcataggcaggaacctggccgacaaggcgcgggcgtttgggatgcagatccggtaccacaaccggcggaagctggaccccgagcatgaggagggggcggagtatgttgatttcgagacgttgctcaaggagagcgacgtgttgagtctgaacctgcctttgaatgtaaggatgggattccatttcatgcccattgtgctattttgatgatatggttgctgacgagacactgcagccctctacccgccacaccatctccaaggaccaattcgccatcatgaagcccggcatcgttgtcgtcaacacggcccgcggcgccgtcatggacgaggccgcgctggtcgaggctctcgactctggccgcgtcgccagcgcggggctcgacgtcttcgaggacgagccaaaggtccacgagggtctactcaagaacgaccgcgtgctcctcgtgccgcacctgggcacgtacacgatcgagacgacgatcaagatggaggcgtttgccatcaacaacgtgaagaaggccgcgctggagggggcgctcatcacgattgtgcctgagcagcgggatctggaggctaagctgctggaggggagggacatttaatttttttgatagatggtatagatggtatagatgtaaatacagttgttggctagcttcaggccttccagacgaccgatgatcatgacgatataccaggattgtccaccgattctctcctcacgctagtccctcattcatgggaatccctcataggagcagttccctatgaagtccccaccatgccagcgaaaaaccacatcgcattgaaacctatatgagcgaaaagagtggaagggaacaaacagtcagggtaatttgagcgagctggtttgagggtcgagagggatgataaatctcctctccaaatttctttattttctggtatcatgtttaagatccagatgacctcatatctaacttgcaacacccccagtccctttccttcggacgggtgagttacatggcatgttcgttttatctgaaaaacttctttctgctttttgtttaagaaggtgggaaaaaccaaatcctttctttcccattcccatatgccacgcaagttttatgctgttgaaaccacaaattttgcccatccatcgccaattgttgagttgaaacaaacaccggaaaacaataaacacagccgtcgttacacgtagagtccagttgaaggacccttggatatgggtatgatgattacagtaaaaaaattagtagcggtagctaagaagaaatgtcagtatacgaatcattgagatgaccatggggtgtgggggtaagcttacatgtcagccttgaaaggaccctcctgaggcagagagaggtactcggcctggacgggggtgagggtgctgagctcgacgttgacgtgctcaaggtggagacgggcgacctcctcgtcgaggatcttggggaggacgtaaacgccgacatcgagcttgccagccttggcgaactcgacgtacttctggccaaaggcagcgtcgctggccttgtacagcatgatctgggccaggacctggttggtgaaggagcaggacatgacgaaggaggagtggccggtggcacagccaaggttgaccaggcgaccctcggcgaggaggatgatgtggcggccgctgggcatgacgaagcggtcgacctggggcttgatgttctggacgcccttggcgttggccttgagccaggcaacgtcgatctcgatgtcgaagtggccaatgttgcagacaatggcgtcgttgggcatgacctcgaagtgggcgccagtcaggatgtcacggcaaccggtggtggtgacgaagatctggccgcggggagcagccttctccatggtggtgacctcgtagccggccatggcggcctggagggcgttgatggggtcaatctcagtgacgatgacacgggcacccatggtgtggagggccatggcgcaacccttgccgacatcaccgaaaccggcgacgacggcgatcttgccagcaaccatgacatcggtagcgcgcttgataccgtcaatgagggactcgcggcagccgtagaggttgtcgaacttggacttggtgacggagtcgttgacgttgatggcggggacgaggagcttgccctccttgagcatgcggtacaggtggtggacaccggtggtggtctcctcggagacaccgaagcagtccttgagctgctcggggtacttggagtggacgagggaggtcaggtcaccaccgtcgtcgaggatgaggttgagcttcttgccgtccttgaaggcagagagctgctgctcgaggcaccagttgtactcctcctcggtctcgcccttccaggcgaagacggggacgccggcggcagcgatggcggcggcggcgtggtcctgggtgctgaagatgttgcagctggtccaggtgacctcggcaccgagagctgtgagggtctcgatcaggacggcggtctggatggtcatgtgcaggcagccagcaatgcgagcaccagcgaggggctggtcagcggcgtacttggcgcgggtctgcatgagaccgggcatctcgttctcagcgagctcaatctccttgcggccaaaggcagcaagggacaggtcggcgaccttgaacttgtgggcgggggcggccattgtgagtgttggctggtgggtggtggaagggtgatgaagaggaggatggatgggatggatgaaagggaagaaagaaggaggtgagggacgggaggaggagaagagttttgttgaacagcttcgcagtggacatggatttgctctggatggcggggcaaaatttgttagcaggaagcggggcagagccatgcaggtagccgtagagactgagcgatttcgttggaggggtaagtccagcgagagcaggccagataagacactcgaacgcttggtgtcatgttgcgtcggcctgcaagggcgaggaggctcttctcttctagtctattgcctgtcttcgcatcacatcgtttcaattacttgacaattcctcccattcccggctgcatcccaactcaattcctcctcgactaccacggacagtccctggcaagatttttgttgttcagggacggagccttaggcgaagatacggggcgcgtaacctgccggaaaaggcacctttctcaactaccccctcaggtatctctcaccacaaaacacgccacactgtacctgaactggagctgttcccaagtacattttacacgtggaccctgtcacaggcccttactggaggtccttctgctagcggggcaacttttttttttcccaaccggcctgtctgcccctcacttgtacccactaacaaatcccgagcccctcgaccctcctccagagataagattgttgcggaggtacctccattgttgagtagcggtgatggacaaacattcccccccttctggtataggcacggtgaatataggtctagctgccacacgtattcgtgttgcttcctcgtacattcttcactctattgatcgttctaaatctaagggaacgaacgaccaggtaacggtaacaagtatatttcattaaatcttttccacattgcccggaacgccaacaatgcaaccatccagccattccgccggccttgtagtgctatcccccctttttgataaataaagagtgagcccagcccttctctcacggtggcaatatgtagatgatgtagacacgaacgcaaaaacccttcctctctcaacccacttctccgcggcggccttgagaagaagaaccctactggggtgcaaggttctcgcggacggcgaacatcttggcgctaatgtttgctgtgaatccatccacctgcttgctgtattgttcgacctgcttggcgttcagcatgccctctagcctgctgggctcctggggcagcttgaagagcctctgccactcgtcctcggggagtggggcctgcttggcgagcacgcgctgggcgttctcggccttgcgcttggcctgccattgcgagatcttggcctgctcacggccgagctggcgctggtagaactggaagttgttgaggtcggtgtagtgcgtctcgatgctctcgaggaggaggtcgcaggtcttctccagcagagggtcgatggagagatcgagggtgtcgattgaagggttcagcgcgggcttgatctggctgttgtggatgtccgacagggagctaggaggctcgacggtctcttccgtgggggcagcggggagctggtgaaggaaggaagtgaggaggtgggagttgcggatggtgacggggagctcggtcagaatgtcccggaaggtaagcttcgacttttgcaggctaggaataaagcgagttagaaattatgagtgatatcatgatgctggcgcgagatcctcacgacgcgtgccggtagagtactcactgctcagtggtgaacttggtatccttgtaggcggccatgaatgccggggaaaggcggaatgctctcagagtcaagttgcccagtgagctcttgctggcgtcgtaaacaagggcgacagccgtcttgctctccttctggtagtggacctggttctcgatgaagtgcatgttgacaaagttgcccatcgtggcgctagtgtaccagccaacgctgttggcgtcaacattgacctccttcaggtgtcggatcatctcgtttgtgtagctcaggctgctcttctggcgaggagcctgggcggcgatggaggaggcatcgttctggtgggagtcggtggaggagccctcgacggtagggaaagggaatgagttggtgacctcgatcaggctctctgtgtccattccgacaatggcgccggtagcggtggtggggaaggccgaggcgcagtgcttggcgatcttgataaccacctacagttacatggcattagcttttgtctgccagggcgcgcgcaccccttggagctggctcgaagtgagggcattcgagatgattttggtggtgagggggggttggtggggcaagttttcgattcgactcaccagagcatcgacctgcaccgcctgaggtgcttccttctgagaatcgctcatcttgggaatttcgctgctgctcgggatgtcgaaacgtaggtcggcttctctcggggggggatcgtttgcggcgaagtgaggttctacgggggcggtcctgcggcgattcaacgaagttgtaaatatcgaactttttgcacccaaattgtgggcgttgtgggtgaagggcggtgaagtctggcagaatgtaccgttttggtgcaggtcgtcggcagcgcgtcggttccgcccttgcctcatcgtcaaagcatgatattcacgcataaatacttcagaaacgagtagcattaaataaataaaaaattgacatctaatttgggagcatattcatgcctgtccccaagatatttgcgctcgtgctgcgcgtaatgcaataaatgctaaccacaagccttgtttccaagcttaggataggccaaataagaggtagtcaatagttgaaacctgcgacccgatttgttctctcccggcacataggttcttatacaaattctaaacgaaaatccaaccattatctcaaacaaagtcagccccttcttttagccttcaaggctacctaggtacccagtgggaaagagagattggcactttttatcctccgcctccctcgatttaaggaacagtacagggtaacattccatcaccagaaccattgaccaaaactccgtgcatcccaaaatccactataagatgggccagcacacgcgttttgggcgctgcaatctgtattttcgcgcactgtcgcgcgccattttggctcaacactatgtggaagaacgtacagttgaaaagagggtgtaatcgcccgcgcataccctagatcgatcattgcagtcttttatgctattcctccacccgtaaaccatcggcgcgggcaataagaagatctccgtcgcgcacctctcggatcccaagggctgcacgtctctactgggttctataccactgctctcatgccccagggccaaccaaccgcacctcgtcttagccatcgggtactcgtatctagacaacgaccgcaatgagaaggcattcgtagtctggcgtcaatgcgacgcatgcaaggtgaccctctgcactatccacacacgcaagcctgatctgtccatccctttccgcttgacagtcttcgtccttgcttcctactaagccgccccatgattgcaaccagacttcagatgttcttattccatgcgttgggttgagattctgattacctgctatatcttgcttctgctggtaagcatttcgcatacgccttacgcctcgaattttagcgagagcagcagacttatgttggaatttggacggcaccggctgaaatgccacttggataccaagagaatggatatcatgacaaaatgatttgcccacaccaatatctctgggatcaatggtaagtgctcgttattagctagtgatcatgccaatacatccccccgctcccgcagtcatggtaagggaggtgagaccggaacgaaaggacaactgcttttgaaacaatttgcctacttagagtgccccttctcctttaaacctagatatacatcctgcccctgaaccggcaagctggcgacgggacttggtttcgtgctatccatctgcgtgaaattgggcttcgatccatctcccccaactgccttccgagtcatttcgacgtctatttccaaatcaaacctcataagaagagaagcgactgtgtatttgatactctgcttagctagaacgcgacctggacaaagggtttgaccaccaccaaaagggcgaaatgattttgagctgagtaacttggggttattttgaaagcgggctggatctagaacaagaggctcggtgccccagacatcttggttccgatgcagctgacggtaagggacctggattcttgtcagcagccgtgtttattatacttacttttgttagagatagatgacgaggaaaaattaagcacactaataccttgctgccgggtgggatggtgacgtctcgaagagtggtaggtgaaataacatcacgaagaagggcagttgccactgccaggcggagaacctcatttatcaaggactcgagtagggggcactggaacaagtaagaggtatctaccctcccctctcgatatgcaggtaaaagctcggcacggatggatttggagagggtttcgtcgtagacaatgtgcgccattgtccagaaagcagctttgtaaacatttcctaatatgctgtggtgcagggagtcagtcttcttggtctacgttcgaaaaaaagagaaaggcatcttacgcccagaagtatagcaagaacacctttgccatgtcctgctcagccagtcccacgtctcgcaacattacttcaacagacctcacgaaatcgctgcagtcagatctcgcttctgccgggatagagaggtatttggcaaatgtgttgatgatcccgtcgcgagcccatatcatgtccctgctcatgaatgcgggcattttaaacatgtatttccagctctctcgctcccaaacctcgaagtaatctaggaattttggattaacatgccagatcttctgacccagatatgcagtcgccgccgaatggaggaagagatctgtgcaaagcttgaggagagaaacggtagtctcacagcccgaggatccgatgatggaaaagctagtcccctccacgacgccctgaagtcgacgatcgatcccagggcgtaccctgttttgcaaaagctcatcagtgggttcgcctgatttgagttggcgtcggtgatactcgacgatcatgtggcaaggcggtgtgacctggaaagtagtgtcagctagctggacacgcagaattcacgtattaccggtagattccctagtaccgaggactttatctgttagctttgttgaactgcaaaacagtccaatgaggccataacatacaaggaatccagtaaggcagctcttttggcgctgatgggtgcagtaaagggaggacggtgaaccgccataacctccatccaaggagtgctagcaatagtaacagaacgatgatagctcttccgtgcaaaaagggccgaaagagggccgcaatggaattccaaagcatggctacccctgtatctggactgagctgctacgtctccatttctctgccgtgctgttgagttgcacaccacaggagctaagggatgctaggaggaagctgtgttcgcggcaaaagcaaagggaggggaatccagttcagagcgcccgattatgaaccgcgttgatgttagtggcgtttgctggtcgtacaagcggccgccacagctcttttctttatgtgaaagaccctttgttcagctgctgacaagatggaggtgatagattagaaaaaggaaccaagctctctcgcctcgccattcttaagataggcaagttggtgtaagttaagcgtttgtaagtcacaccagggacacttgtctatctagcatcggaaagagaagcatatgaaagatctctcgtctgctacccgagattgctacacaactaacaccaaacaataatcacggtagtgggctacggtgccaatctttcctcatgcaccgtgcggcccgtggctatatattgggtccttttgaaggctattcatcatgtaggtaagctgatgcctgttcagcctagcggaagcacttcgcaaagttcctaggaacatgaaatgatgaacagcttacaaaaagaaagttatcactaaggacatggccagcggagatatctcacatgtgtgtgccaaatttgcccaccgtaacagctgtaaatctttagattttatgtcaatttcagctgaggaaggggaaactaatacctcgcacacagattccatagtaacacaatgtcccgatctatcagcaggtgaaattaaggatgttagaatatttgcgtatgaaaagacaagagaagacatatcaattcgggccaatgttggctactcacaacagcagcaagggttgtccctggttcaatgcctacctgttagagatggttcttgaatatctgcaaacgaaaagaaaggcaagatagatcatcaacagaaagggaaagttacttacaatcgtctattgtcaatttccgacggacaatggctttgttgtagaatctaaccccaacgaaaagtagcatgatggcgagaagaggtgtgccaagtgtgattacaatcggccctttggtctctgggttgaccaaatttggttcgacaccagctggtggaatagcggctggtgtctgggccagcattcccgacgaaagcattgaaagatccatttgtgctgtctaggacggactgagctgactgagagtaagtgtgatccaaaggtgggatcgagcaacgtggatggtgttgagtgggtgagtacaaatccagttatgcggacctaatattgaagatataaaacctcgcatgtaactgtagccgcaaaagtgactgtctaatagctcaaagagagggaaaagaaaactgcctgatcaggatttcagactaacaagcgctctcgcggcaaaattgactaaagaggaagggctgaaagcctgtaggatgtttcttgcattgtaggatttgaactttgggtagtataatggagtctatgtgatgtctctgcagtagtcagttgggtctaagctaacagaaacataaaaagtcctccattggaaatatgttcagattcaggtatgaagagcttgctccactgagaatgtgcgtgggacgggaacttggcttctgtcaatggtgtcaagcaggattgtgtaacctggtgtcgcaggaacgagatgcagattaaatgcaagtgttgggcgttctgttagatacgtataagacaagcaagaaggctgtgttcaagaacacatcaccgaggtacatatcatgacactgaaagatacgactcagtgaatatctgcaaacctgcggattgaaatattggatccatctgtaggtaatacatatttaccctataaccgatttgcgttggtcacaaagagatcgctttccattaatctctttcagcgaatggatagcttgtgataatagatacctttttggttagggctcttgaagcagtcacattttctgttcgagcctctgtgtgtcggcttacgatctcatgcacaaccccgatgtctatgcccacccagactctttcgacgcaactcggcatttgttgaagggcgatacgggccagcaaaataagtttattgaagtctcggagcactttcctgtgtggggttacgggtctctcgcatgccctggccggttgcatgcctcggtggtaattaataagatgattttgtcagagctgctcccgaggtatgatttgaagctagagagccccctggcctcgactaggtggtcttgtgaaactttcactatgccgtatgagaggacacgggttattctgaaagagtgcttatgaaaagggtttcaagtataggatttttatgttttacggtatcaagtttctttctatgatgtactcaagttgtgcttgagcaaatgaattctttatcaatacatacacgcatcttgaactgtgtctagggggggcaagtcgcacgtggccttactgtttccatttagctggctgtgttattccagctccttttctttcttatatcacctacaaatatctggaaataaatcttgtccatggactagacccaactggtaggcgattggtaagtgtacataccaaatggaagcactgtggcttggccctcaccttgtgccgggcttgcgccctcgccggtgcttctgatagatgcaatctatagacttgcgggcgcatcgctcgcatttggtcgcggccaaggctccgggacagcggttcatcttcaactgaaggcatgcgaggcaggcgttcatgctacctgtgagtgtagaccagaggcagtctgagcaaagacagataccacagtggtggatgtgttggaccccaaggccatgaaactggagctgaagtccaattgcaggttccaccttaatcattggcttttcgatgtaacacaataatttagacatttgttagagaaattgttccagtacatttctctactcctgcgaccaacagagccaaggggccacaatcttatactaatacatttatctcaagtttaacaatacccatttcgccttcaactataataacatccccgcacgtagcctatgcctttctatctctaaagctcatagcctctcttgccatgatgcccccctctgatatctgacccatgcccggagtggccacccccatgtcccttggggccagaatagcctctcttgccatgatggccccctctgatatctgacccatgcccggagtggccacctccatgtcccttagtgccagaatagcctctcttgccatgatgcccccctctgatatctgatccatgcccggagtggccacccccatgtcccttggggccagaatagcctctcttgccatgatggccccctctgatatctgatccatgcccggagtggccacccccatgtcccttggggccagaatagcctctcttgccatgatgcccccctctgatatctgacccatgcccggagtggccacctccatgtcccttggggccggaatagcttctcctgctattcgcgtgtcccttgtgccccttgcctcctcctgatccatgggagtggccacctccatgtccactagggccgtcatggcctctcttgctatagtgctcctcgcctgaactgtggattacacctgagaggctgcgactattgaggctctccaaaccgccgaggagctcatctctctcctcaatgtcggtgaggctgcgaagcgctatgtcgtctgactcttcataggaagcaacaaccagagtagcggcagaagcggcaaggaaggctgagaaaagcatctcgaagtatccttttaaaaacttgagattgttgtatggtgatttattctcgaagaaaggaattaatgatggcttagaaaagatgatatatcgtacagatttgtggtgtctgttttgtgaagtctgctctcctcttagatgctcaagtggctggccttatatactaacaacaatattgagagttccatttttagaaacatcaatatagtatcttcacatcatttgggactctggcagttgtatgcaagcctcgatagtaagccagacgacgatgataccatttttagaagggcccgaggccgtctagttgaggtcgccgattaattagattaaattaaattaaaggaagatagcctctaataccagtacatagcggaaagcacaaaggtaactgacggctgatgcttaatgtagtagcataccagggtttgtcattcgtctatttcctcttttatccaatgtcctgcatccaacacataagccttcctaaccataatggctcattttattaataaagaaaagtcattgaaaaataagcttgcacgaccagacagcctagatcaacgtattaagggtttaatgctatgaagagtgatgaatggatgcaattcttgacatatctatctacaatgggggtcgatcaacaagaagagatgtggccaatcaccgagggagtatgaatgccacgtactatactcaagatgcagaccccagtgaccatttccctaatgggttacttgccgaagcgaaatcctctccagtgacatgtaattttaattaacaaaccttgcgcgcgcattcgatcttcgatctaaccctatatctaataaacgatgcgagttggtggaaccccacggttacgaattaccacaggtgctctggcactgttccgtaggatcaagatgactgaaactgaatgttatgtacgttaggttgatcagttctcaattattataattagagtccttttgataggtaatatactcaataaacctcaggtatattaagagcaacattgatatatcatcggctcactgcttcgaacaaggctcttccttcccttatacttttccttccttttctacaataacggcatggtggcgatagtgtagtcacttgccttatgtaaggataaggtgccccagtattgttgagatattccctcatgtgataacttacgggtgtttattcatgtaggaggtggcatcgtggacttttccgtggatgatcatagaacaatcatattcagtagcgtgcttggccacttcagtgatagggaatactttaagacataccggacttgattgattttgttactttgccatattcacccccaaacgaattgttatagaggaaactatggccctactatcgggcagtcatcaaggtaaaagtacatcgtggttggccagcgaaccgtatgttgtcggtgactaggtatcattaagtcgctggtagtttgctaattcaccagccggccggcctatgacccagccccgactttgtcactgatagggacgctctagtaaagcctcgactgtttttgttttagggttagaggcttttccctctcaatcattggaggacttcaggtcgccgtaccgtgcccaccagtccggtttctacctggcatttagtgtgaattgatgacggccgtggacacaattctacgattgtattacctcacgattgatcaattggtcactcacttttgtattttgttctcgcgatcaggatatgtcgcttgttggaaattatagaaaatctagctttatagccttagctggatcatgatgacacgttgcccgactggctggcctatagaaatccccccaaaatgtaagcgtgatgcgaggtgtacgtaataaagtagcttatcaggcaatgtgaatgtgaatatacttatgcttcccgaagccaacggtgaaattgaatggctttttgtcagccagttgtccaccaggctttcctttcataagatccggcagaccgctgttcaagttcaaatcctgctgtgttttccaccaaccaccacaattgtctatcactctcgcagatctttgatatacagcagaaaaaggacagcatatcaaagtggttcgctttatttccattgcattgaactctgcagctatgactggcgtgtctcaaggtggctccacgaagcccaagtctgcaacagggcagacccaacacgtcacctacatcaagcgacatccctctttcacgcgagaagacttctggaagtactggcagactgagcatgcacccagagttgcccctttggccgctcatttcaatattagccgctaccagcaggtatgctgaaccagcccataatctgacatcgtttgcgcgcgcccttgaaatgttgctaatacggaagtggcttcagatccaggtcggcggcaagatcctgccaacggacgccggggctgatggtccatcttctactgagctcgttgattttgatggcatcgcgatgttcctctacgagtcgcccgaggctctgaccgctatgctttcccacccttactatgtcaatgtcgtagccgttgacgaagctcgtttcatcgacaagagcgctcccggaaatggctttgttgctatgttcgttggtacaaatatcgaagttgtggacagggccgaggatgtgtgggttggtgaccgggagcaacacgagaagttccagaagctcttcaactcctacctgtaggagagtagcaacaaaaagattataatatctgcacaagtaatttagttaggctgctgagcttggactagcaaagatatatatatcgtgcgagagacactgctgttacaatcattactacaaagagctcgtgtggacaagttatcaagctcttggttttctcatttatttctttctttttcgatttttctatatcaaagtaactctatcatacgcagcgctgaaatgtttcctcatagctgttaagtcgagttgggctttcttgccaacttatccgttaacaatggctgaattcataatgatgttcagcattgcgaagtctaggttacttgagggagacccaccacttgcgcttatccgaatgtattcgacagcaatgccccctattagacttgcacaaggtaacatcgcgatcgtagcaacccagaacgcctagtggatacgagttcctgcaggctagatccatacgcctgcacgcctctgcctttcctccacggccatactcgctgtatgaggcccgatccatagcatggaaccaatctggctgggcattgcttcttcgggttccccgggacaggatcctgtaatgaccctcttgtagtttgtaaccgcacatggggaaccctcggcctgctgggtgctcaatgcctgtggataaacttggacccgtacatgagctcgctgagaaggctgatagggctgttggtggctgctaggctgtccttgcgcactatccagagccgaatgagttctctttatgttctctttcaccaggggtgcctcacccccgtgtaggagagtacggaccttctcctcgtcggttccatagctgagacagtcacactcatccaggcggaagcaggtcatttctgggaggtggttcggcacaagctccggaacaataaaccgtacggcacttgtctgataggagaggactaggtcgcgcatttcgcctgcatcgaatttttccgggttgatatagcttgaacttgcctggcccggaatgaggctcccaaatcagctccatcctccagccgcccgatttcttatagaaaagtcggaccacgggcccattgacctcaaaagggtgacattcagtgcggtgactcagatggtcagggtgatcaaaggctttcatggttatctcaacctcaaaatctggtcgggccgtgcgaggtatcttagctttgcactccccgaggaatgatctcatttgtgaccacgagatggtctgatgctcgcagactcgaacatagcccttgacgccgttacatatccgttgcttcttcccttctcgtgagaacatagcataggggtggcatgcggcgcacacatggcagtaacattgttttccaggacgaaggaacttgcaatatcctttgttaagttccaacttgccataccgccggcgtttattgtattttagacagtcggcgcagaaagtatcgatatgaaggagatggcatatatcggcacgcagggctgcgtctgcgtctggctcgtccaagaatgcgggagaggggaccagcttcatcaccgcgcctttcgatctaagaaacagatctcatccattctggctatcaggcataccataactccggactggtgagaagccatgatgaagaaattcccttggtcgcaaaaagtcgacgaaatcgtctgcacacttgacggattatgaagaacgagatttcgtcatggtaaagaagcgcgataattcgaagccaaacttcatcaggaagcttgtacagcgccaaactatggcgttcattgaatatggctcgagaaatcaaaggatcgaactcctcttgcaaaagggaaatcgagacctcagtctgcttcttccactttcggagtgaatcctttctccgtgtatccgtgtagaaaccccatttctggagccacccactgagtttctttgtgagcttcattgtgtgcgtaaaaactgcttgaaatatgagcttccaactagaatgtgagagaaagggggcatgcggctacttatcagccattgttcgcacggttaggtttgtagaagcaaatttaattacgcccggctagctactcttttgcccctctcaaccttcatatgataacaggcagaagaaaccttatatgaaaggaagagcggcctcgccaataagattttaaactaccaaaaaggcacataaccggtgttattgttcgttccaaagaggagatgacgaaagccaaacgagacccaaacttcccccccccgtaatttgtgcatcacatagtcccagctgatcggtttcttctcccaaaagcctatgaagtcattttaattccgtgagagaaagtcctaccgtgtgtggcaaatcccaggcgccccgcatcctcaccgtcagtccgtcgtttcacactctcagcccgttcacaattatggttatcatatcccaaccgatgactcctaattcctaagacatatcaaccaatgcttacgttagcgacgctcccaaccaaccaaccatagacgccttggagccgaagggagaaagggttttcgagctcatgctgatactcgagctcgtgctgagttcctaggccccggcacttcccgtataaacatccaagaatgaccattaaacccatttcgcacctcgtgcaccgcagtcacctgcgcgttgtggtgtgctagtatgactggccatatctgatgtgcccagtggtttgctcatatatcggaatgatttttagttgtctttgtgggtggccgactatcagcccgacttgatgaacccctagattgagctggaagtacatcgacatggtttgaggtttgaaggtcaccgcctcatctaacactcccaattccattctttgctgaaagcaccaggcagctgctcggtccgcagcggactttccgagtaatggaggggtgtgggtatactcgagcagcttatctttgattgtttcatggtgtgcattccctgatcgatcagaagtgatatcaacggcgcctgactttaggagaagctctaaacagtcaatggttgccatcatgtctcgaacccaggtttgcctgagggtaaggttatctaggaggctgtggatcagcccaatggcgtctctctcgatgatcggaagagccgcctccgtggatcgaatgattgcctgcaatgctttcgcattgccgaggcagcacgcttcagaaatatattcgccaaccaaggcctggccgtgactcctcaacggctggtgttccaatagacagtcgactatcttcgtatagggctccagtccttggattgccaatcccagaggggtagcgatgatcatccggcccgggcgtggcaggagctccaacggcttatggatggaacatcccgcctccatgagggcctgaaagactggaagcttcgcggacaagggccatttccactgggctagcatgtactctaatggatcatacgaaaaccataaaaggtgcgggtcggccccttgctccaggagagtcaccagaatgtcaccggtatcagcagagaggaaacggacaagaggatggggtgccagacgggcaatcgtgcaatcctgatcccaagaaagaagatagcgagcagtttctggatcctttttgtcgcaggctatctcccagaacgtcaggacttcggcttcgctggggctgtagtgtccgaggagcatcttgaactcttcaagatttttatcttttaaccgctgctcgagagccgtagtctctcggtcttcgttcatagcaaatgggaattctgacagaatagttggtccagtagtcgagccatttccgcgtccgggcgtcgacccatggcgaagaagtagttccgtaacctctttagtgtcgggtttaccgtcgcatattgatgaaagattccacaaaggcgatacggtgttttcagctattgcgttgggcgaggcgccaaggttgatgagaagctcgaccaactctagtagcggcgtgttccatgtatcctcacaagcatatgcaagaggggtgcaccgatccttctcaggatctccgtcgacaagggcgccggcttgcgccagacgacgaacggcctccgtgttcgtcgcaccagcggcatggcccagcgcagtgtggccttcactactggtgttgaagtccaagcccaagctgagcaaacagtctagcagctcgaccccatcttctttgtcacttgctttggaccagttggaaatcaagttccacgggatgctgcagaccaaatggatgagaggcttttcggcgccccgtagcctgtctgccaataccggatcggccccgcgctcgatcaaatttctggcttgcttgaatctgcggcatgcgatggcgtggtataataatgttcccttatggactggtggcataaaatctgggtcctcgagttcgagctcgagcagcccgggggcggtggtattgatgtctgcaccgcgactaagcaagtagtcaaagcaggcctggtttccgtagagataagcacatgccaacggagtctgccggttgtagttgtctcgggactcgaggtcaatgcctccgacgtcattgagcagccacttgatgatatcgacacgtccagctatgcaggcagtgtgcagaggggttagacccacgagtgtacggtctggttgtcgttctacgctctccacgtccatggacacatgctgcaagagatatctcaccgcagagagagacgggcctgaacagatggccatgtgaaacggtgtccagtctggcggtcctggcccaacatttgatcttgagccgagcacattgatgcccagtggccatcgatggcacctacacatgccgtgacacgccttgtcaggcagggcaccgtttcgaagcagaatatccaagatctcggcatttccgtgggccgcagcaacatggatcggcgaccagtacgtggagtagagagccccgggcatggtgatttccgtcccagtatcgccatgggctggtatatcgtttggcttgccacgatgcccgctttgattctcccaagtgctgttgacatcgatacccgcgacgaggcaactggatactgtgcgcggcaggtcatggactacaccccagaatatggcccttagcctgctatttgaggaggcaacgactctatacaggacagagttgagcacgtcgtgatgcgcccgtgagacgctggcgagggctgccaggtcgcccatgctagtgagatgctgggcgacaatgatccagatctcgagaggaaggacggggtaccgtaaaggctcaggaacattggtgctgtccatagctacagacgagatgattcgacttgaaactgtgcaaggaggagaaagagttggcaaataggctgctgattgcggcgtggtttcatttgccccgcaaaatgacggtgagcctgaatgcaatgcccaatatcacaggtccaatcaaatcagcggaagaaaatgtatgttccattgcaggtattatatgttgcacatttgtggttgatagttgcatagattccttccaatagtaatagcattcacgtcccagcgcttgcggtatgctaaggctactctctcatcaacatagagtaaggtgcccgcatatttgaagtgatccctcaaatgaaagctcttgcaactagtttcccaacccgaaaggagcttaatggcttccggagttgcttcttataatgactctacatgttgaaaagtctccgtagaaactcaaaacgcgcggccacgttcttatcctcaaccctgtagttataaatacttctagctgcgtagcagcgatatcgcaaggacttgtatcggaacctcccatagcacgcgacgcagctatttcgtgtaatgagaaggatatatttatacattaattcgctgttgcatagttacgttacagcgcatctgagtaggttcaccgacgttgtactctggaatattatagggtgatatgtgtatttcccctcccctatgacgccaacctcatgtccgctccgagtaggtgtgcaacaggataactgagcagctggctagagaaatcccccgagaagagaatatcgctatgagctttcagctttgtcggtgtacattcttaacacctcgcatattgtggcacggggtggccggcccggggacagcttggtcttgattctgacggtaggtaggtaatgctttaccgtatcgttgactactttgttgggtggtattgcacctcgtattcacgggcgtatctcgcagtcatatctgccaatagccatgctactttttcggtgatacaacctgtctttcattaaacccgctgtagcacgcacattccaaaacgcccaaactctatcctacttgaaattatcatcaactaccctctttgttctcggaaagctagaaaaggctctcggtgtatttacccgatctagttgcgtgatagggaattcggaagatggtgtgtaggtaataagaggggtagcgaaagctaggcgctcggcgtgagctcagttttgacactttgagaaagttgctcctcacgcgggtcaactcaagcttattttgcccagctcatgctcccatgggaccctttactgccactcgatggctagtgatactcttctcttcttcgtcattggctggctgatctagttcccgatcttatggtgagtagaacgactatagttgatcatcgtgcgtctctgcctgactccaaagcgccacgacgactggtaaaaaaccgcgcaaaccggtgtcaggactgtgctagatgatctctcccgtgttcggagcggagcgtgacgcacttctactgctgaaaaccggtgtgcgtggcacagcatttctgtcacaattcgaagcgagttagatatgatatgcgaaaacgtcgggctggcacgaaggtcgagtgactggcgcccaaaatggacacatgcatattcagtggccagccacggtcaggcatggcatggaatgaatgccgacagcgcatcactctgaaacatcgacaggcacatgccatctacccttatcatgggctccacgtgagaccgccctaccgtcacatcgcggtctcgcgtctttattatctatcaggatcccccaccgatatggggatgactagatctagtagcgtcaagagtcccccagagttgtacgagactagttgaccatgcccttcatggatgaagcgacggaagcatctccgctcataccggtgggtgatgctgatcggcaagagccggcctattcacacacaaatgattccgagtggacgagggacggggtacagaccgcagctttagctgcctttttcatccttctctttgctgtagcagatgtctttagatatttctcaacgctgcagctgcttgagctgggggtctgtcacgagcaatatactgctgcgaatcctgacgttcccaaacaagctgcccagaacatccctggggatttctgtggttctccggcagttcaacagtatgtcgcagatctgcgtgggtacttggttgcgctggaggcccttgtcggcctcttcctcacgctaccttatggccttctcgtgaaccgatgtggcgagcgtttggtggccggactgagcctcctgggagtttcgattgcctgtgcttgggttctactggtttcattttccaagtctgcacttccgatctggactgctgtgcttgcgcctctcttccaagtgatcgggggtggctcgcctgttctgtattcagtcctctactccattgctgcaaagcacatcccggactcgagcaggtaagcccacaaaaatgtttttttctgactccagtggttctaacacaagttagatctctttgttattcattcttctcgggtgcgcaagcagtgaccgagattggcgcggtcaacatagcggcgctcctccttgagaaaaagctcgagtacacgccactggttctcgtctttcctgtctgcactacatgtctcctcacactcttctttatgaaaccgaaacaggtggccaaaacagcgcgagaatgtgagagtggaattcctgaggaagagagcattttggggatggggtctttgctcaaaggcgttcacgctgtggtagagatctgtcaaaatccaaacattctaattttactagctatcttccctataaccaagctgattgatacaatttatggtgtcatgatacagtatatcccgaggaggttcgggctgtcctttgctacggtaagtattccttgagcggcctcgtgatggtcttcatacgctcgactaacaatcaaatagtccagccgcttgtcctcgatcccatctttggaaacctttcttgttcttgttgtgataataccactaatgaaacacatcgctgagacgaaattccatgttgcattccgcaaggtggacatgtacattgttcgatatggattcctcgtaatgtcatcctcttgtctgattatggcattatccacgacattgattacctttatgctaggtatatgctccatggcggaccagattcaagaagtagactaacaactacgataggagtctcaacattctcattcggctcaggtgcacgccctgtgctccaatctatcttgacagatatggttgatcgcgacaaaatctcagtgctatataccctcatggctgttggagatgcccttgtttcagcgacagggtcgctcatcattcatcactccttttccattgcgattggatgggaaaatctgctgtggctcgggctaccatttttcatcggcgcagcatgttatttctacgcatttgttggtgcaggtcttgttagacacactgcactttctaggaaacaaagcatggactcggattcggattagattagatacccttaaagcactttagatctcataaagctagcgattttattttccaaattacgtcccgtacgatcgtcacctgccatagaagttgatgtctgcaatgacttggatatgaaagataagacctgaattcgcgcctcattcctgacgcgtgacatgatcacaatgcactgaacttggtcatctgtcatcactaggtcagtctcacgcgggccgcctcactcatgattcagctcagcttgaattctccacttgtcgaaagagacagtgaatgtgtggcatcgatcaattatcaactcctcattcggccaccaccactatcactagcttgagacagcaaaccggcaggatcgtgtatgagtcagcttaaggtaggatcgtctcctccacggaaactcgtgtctgatgcagaagagctaatctatacgagacccgaaagaacttgaagtcatcccattagcatagtttgcgcctcaatttgttctaccagcggcaagaaatgacttgttctggcctcatgtaatagttttatagacataaatatcgtaagactctaaatctccattcctcgctttggttttgaaagtgagcctcatttaaacagagtttagagagaggtgctgttgtctacatacgcaatatgatgggcgagtatagtttgtttccacactcacctgactcaagaagtacttcaaacgtctttttggaatttacatagatatcaagagctcattttggattcgcaatttgcgtaagccatttccgatacagttcagatttcccccatctcggttatcgagaattgttgtagactttctatgctgactcgtcaccactttcttgcccaccgcttactctcggcggcaccggtaggtcagcatcctcgcgtcgctatgcaaacataaaacgtctcacccttggcttctaatgtaggctaaacatgcgatgccaggataacccttggcgcggcggacttaaagaatatccccgcagtaggttgcagttcaccttgaactagtcataatatgaaatccaacagcctgatgatgcggtggatttgaggatatcgccgtgttagcttagagacggtagcattgatgaccaacttcggtttgacggctgggtataaaagcctgcgtcagcaacccccaagtacaacgaattatacatatctataacatcacacatctggctttgatctataccgaggatttaaatcaacctactatttattcaccatggtctttcctgacttctcatctgcccccaaagccagcagcggcttcactctcccttggaacaaggacaaccttcctaaacaactctggatcaataacgaggtaaggagatattgactgaagaaggcgcagaattttaacaactaataatcctagtttgtctctagcaagagctccaagacgattgaagtttacaaccccaaggatggaacactcgtcgccaacgacgttcctgtagccggccaagatgacgtcgatgccgctgtcgccgctgccgaggccgcattcccaaaatggaaaaagacccttcctcgagagcgtcgtgatttgctcaacaagctcgctgatttaatgatcgaacacttgccaaccctcgcgacactgacccgtgtcactcttggcatgcccagcggcggatttggtactatggagatcaatgtcgctgctgaagcggtcaggtacgccgccggctgggcagacaagttccccggcgagtcgcacatgcaggaagacggcttcatgaagattacccgccaggagcccctgggcgtcgtggccgcaatcatcccattcaacgcaccaatcgccgtgctctgccacaagatcggcggagccctcatcacgggcaactgcttcatcatcaaaccctctgagaagaccccctttgccacgctcgcgctgggccagctggctaaggaggccggctttcctcccggcgtgattcaggtcctctctggcgacggcagtacgggcgtcctcttggcgagccacatgcgcatccgaggcattaccttcacaggatccgctgctacaggtcgcaaggtacaagaagcttccgctaagagcaactttaagcgtgtcacccttgagcttggcggaaagagccctgctatgatattcgacgatgccaaccttgatatcgctgtggcgtggtgtgtcaatggcatcacgatgaactctgggcaggcatgtgttgctgccagccgtgtctatgtccaggagggcatctatcccaagttcgttgaagcctacagggcggcgcttgaagccagggcgaaaacggtaggtgaccctgacgagagcagcacccagatgggccccattgtcgataaactgcagtttgacagggctcgcggattcatcgaacgcgccaaagcccagcataagctgcttacgggtgggatcgacgtcagtgacaaggcaagttcaactcattccccaaatcatcgtcgctctttaggctaacatagtacagggttactttatccctccgactgccttcacggatgtcccagaagatgcagaaatcgtgaagacggagatcttcggtcccgtggccgtgatcaataccttcaagaccgagaaggaggctcttgcaaaggccaacgacaccgagtacggtctttttgctggcgtcttcacccaggacatcaacaaggccatgcgtatcgttgcagagacggaaagcggtatggttggagtcaactgcatgagctacgcttctaccagcgtcccatttggtggcgccaagcagagtggcgttgggcgtgagagtggcattgacggcttgcgtggctttactgagcccaagactgtcttcattaacttgaactactaagatgatgggttatactcttgtattgtaactcgtaaaatatacctatgtcccacggcgattagtaattatcgtgacaccgtaaactccgctttggattaatctcgcccttgcgccctgtacttgacatggacacatggtggcatccacaccatagtagtggtagaagaatctgtataaaaggtaaataccctcagcttataacaatctagacgagaaaatagcagcctgctcaacatttcatattgatgaccaactagattcatttctctcacgtctcagcttcccccttagttcttttccgaaaagaaagcccttgataagcagcctcgacatccaacatggcagcgccagtttccgtccctgatgtcatcgcctccattagatctcgttggtcaccacacctcgtcgccaccaccaacgatcacgatgtcaaagtcgtcaaaattgacggtgccttcatatggcatgcccatcaaaacaccgatgagctcttctatctcatttctggcaagctcacaatggagatggaggaagaggccgcccaaggagaagccagagcagagatccgcaacgttctgatgaagccaggcgacatgttcaacgtgcccaagggtgtcaggcatcggcctgtcgccgaggatgccgtgatcatggtgatagagagggaagatacggtcaacacaggagatcaggtggactctgagagaacaagagtagacaaggatgcgcgttaagtcacttcgagtctatttgcgtcattgtccaatctctcctttgaatataaggcctatcgaaatagatccggtcatgagagactacaaatgcaatgtaataaaaaggaatttctagcagccaagtgaacttccataaatgcatgacgcatacgacaacgaaagcggatattcagtgcccagaattcatgttagtgcattgcgaaaatgtcttctttacagtgaatacctttagcggacatgcttaacattggttgggatggaatatttgtagggaactgaagcttagatcggggacatccaacccaatacgtttgaagtactctcgctcaatctggggcgtctttcacgtagctaaagcgttctagatcacttcttttggtcttggggcttgaaacttcggtccaggtaatctgattgcgtttgagagaaggcgccaagatctggcctggcatggtcggacgtatacggcaatcaccaagggcttctggtcatcactaggttagtatcttcaggctagattagtggctgaagtgcttcgattagtgtgatactaaataagtatgaaggtaagtgtatgacaactaggtagatacaagaggttggacaaaagagggcaggatgaaaagcgatgtaacgagctgctcatctaaatggcaagggagtcatcggtataaagttctatagacttttcctgctgtatgaccataggtttaggctagcagagcttattcctttttgcctttcgtattcatggtgtcaagatgtcgggtctggaatcttctggtgctgttttctactagacggcccgggagcaaactctattgaaatgagcctcgaggaacgaagagacacatactagaggatagaccccgcatcattaaaagaaaacttagatttcaacatctttcatcccaatctttttgcaatatctctcgtcagccaagccgcttcgcatagaccccgtccagaatgcgtgaaccaatgatttcaacaggtgctgggcccgacgacgtcgccaatttgaccggagaattgagcattgccgatcaccctcaggtcggcgaccacaccgacttaatccaatcaactctcagaaaagcgatactctgcttcgatcaaactgcaacggccgcttgccaacaggggcaacaggtccttgcttcaggtagtgatgcctccactgctcgtagcgtagctgtgtcagaaatctccttgctgtataggacagcctacgagcttgaaaatgatgccaaaatcctcagacattggacggagagatcaatcgttgaacgtgtcagcttgtttggaggccaaagggggcctcacacaaaagatctactaaagcacttccacaagcaaatcatggagaatgcccgaaatgtcctcaacagctccgatgatgaggcttgtgtattatggcagactgcggaagagtgttacaaagaagccattcgtccttcaggtagactaggatccgacggctacttctattggatagatagggcagccgaagaatcttatgaacatgaaaatcgtctagatgtggacgaacactacgccgagcttaggagtagaaatatgaaagtacacgaagcccgcaagatgaaggaaaggcaggaaacacgacaaaattgggtcgaattttgggttcgggcattgagcaactgcccaggtggcccgacactgttctacccaccagctgcttgttctgccgcacgatctatagaagggccgccattcgaggatattccacactttcttttccgggccttcgactcgaaaggctctggcaaaaccgaagacaactacctggcatcaactatgagcatgttcggcaactcagagggcagcaaggtcgatattttgtctcttgaaacacacagcgcgtcggaaatgctctatactcacttagttaaagactgttttggcggcagtgcatccgacaatctcatgtcttggagcagctctctgatgtgtgtgattcaatatgcgatttggagatcccatatcggcagtctctcaccagctgaagttcgtatttgtgtaatacacgcagccagatttccacccgggcaatttgtacgagatatgacactgctaaaagcattcaacaatatggaattgagcgaaaatcagaaagatttgttttgttttcgtctcgagaatcctgaatacgacaatggagaatatctttctcaaggagtggttaatcaccgcggccgatcatgcactttctcactgcaagacttgatagacggtggactctatgagttatatcctgagtttggagataccggatctggggggctatggacgaaccgggtacgagactttcgctcttcctgggatactgagcgggaaacgacccgacaagagatatatcacgcgttcagcatggcaaggatttgctcaggatcaatcttcagtgagcttgatattgcggtgctacttctaacttttaagaaccgcaagattcaagtgccaggtaagacccacttcccttcgatggcagtttgaaccaagtaataacaaagcgctagcacgcctaagggattacttaagtcaacttgatacttacgggccagttgaagtccgtcgatataagaaggccagagaactgcaactttgcgatgggcatccgatgccatgggacacagagcgatcaaatcgttcaagaaacatatcatttgttcacgaaatgtttggatgcattcgagtgtacaacgaatggaggggcgaggactagtccaacccgattgtcggagaaggcatgggggctagataatgctcatggctgaccaatgaatctgtttaggggtcaagttgagaggaagggcattgtctatattcgtctgtgcgcatcaaggcaagtgcctcgcttctcagcctcgttctgaaaagcactagcggtctccgtagggcactggtctccttttgacataacgaggtgacgggtatcaagtcaccacactttatctattatcagtatccaagccctgtagctttctcagagctagtgatcaagcaccgcggtttgatttgtactagtatctgaaccctatcatttgacttgcactagtattcaaacatattttgccctgtattggcacccagagctttccattcagcctgtaccggcaaggagatggacaaaattacaacttccttccattgttatgcgactctccgacggtttgcttacaatcggttgctgcgcggccaggcttcaagaacgcgggagacgccccagacttactatgaggctaaggcagcctttgactgaccctttccgtgaagattgtacgctcaccgtacactatgcttaagattgaagaggcccagcaatagcactggctgatattgggtattccggggcctggtgctgttggtttcttcaggctttggcaacgctattgcgttaagagaaatccgtgagcaagcaattatagacaggccacataaggggacacaaactagacccatagtagccccgggagaggtcattggcttttttcatgttggtttaccagaaagtgtgatgacgtctgggttgtggctaataggactatgtaaggagaagggtcactagattcgttgccgggtttgtcggttcagttcaaggttattaacggcgttcatcagcttcttacgcgcaaggagattttgtgagctgggctgacttttgggaggttaagggccgcgggtcgacaaaaaggacgttctcgccaactacaaacaaagtagaaaaggaatagccccccaagagaacgcgacatgtagatctagaacatcctaaatacgcaaaacaacgacgaaacgggggtttattctttaccagatccgcctcttgtcaatttcaaagtaaacaaactgtttacgcttccaagcatacctgtgatcgggggaaggcatggtacgggggatacaacgaggttcaggcacggcgcgtatcacattactaacatctataattctcggatctcgcttgactattgccagccttgtatggctcagcagggagaacccagatactaatcataattttagaagtgctttgacatgtgatccttgcagggaaaaatagattcactctcgcgccgttccattcccagccaagaggcttcagacaaccccccccctttgtttttctatttccattgttccattcatatcttcatgttggtaatccaattgtggtgtagtcgcccagcggttgccggggagtagagagagacccatgcaaagaaggcgcagtaagaaacagggggcagccaacataaatgaatgttttctatgtgcaaacgacggttgtatgggaggctgaggcaccaggtgaacggatgttggtcagccgccacgatatcgatgttggttgagggtttccaaaccataccatagcagcatcactcactttggtgattaagacatgaggtcgagggcacaggatcaattggaaacaccaaggctttcccaaggcatttaaaaaagaccaataaaacgcggctctgagtctttgtatttgcaaaaccgtgtatataaagtcgtctttttcgtacgaaattcccagaaaccataaccacttgctcttcaatctcttcagtcttcttgtagtctcagcacttgccttagccgtccgctcaccatacactcgccgccctcgtcaatacttctggcggtccaacagcctcccccaactcttacaggcgcttggcctcttgctcctttcaatgtgagttcccacagtcccagaattatcttcgttctaacggtgattcaatcagatgtgtgttatttcaacccctctctacccctgtgggcacatcggggttagacgtcgggatcctactggttgcccgaaccccagcaattgcttgccacgctattacacctacgatgtcatggggtgatgtggtaggcaggaatgtctcactccgccttcttctgatcagtaccgttagaggggaggacttggacgatgatgatctaggccttgcccaggagaggggtgaggcgcagtctgcttttgatggttggtggggaatagttgttggttggatggatgtttggttgttggtcggatggatacaacagtggattaggtagcgcttttgcaaacaccagctggtcgggtacccgcccctacctgtattagatacattactttagcagtagcgtatgtatgtaggtaggtagaatagaactggagtctgcctataactagagccgcccgctcccgccgttttctcttccttacaccacctgcagccaatctccaaagcaacataccaatcaaatcaacatgccgtctcgtcttgttatcccgccatgcgagcataatcctgcgcatccaaatcatctcccatcggatgagaggcctcttcgtattcaaatacttggcataaacagtctcattgatcagctatttgaagatggcatacacatgccctcccaggatcggccgattgtatctccagttgattttgacgaagtgggcattcggttcgcaaaattggcctttaagcagctctaccgccgggatgtagatcccaacaacacatctgacttcgtcccacgataccagtaccatatataccagggaaaacacggagagtgccagccatgggaacacacgtaagagtcaactacagactttctaacgatcggccagctcatttggatggatacatgctaatatcttagcagcatcgaaggatatggcatcacttttgaccattacgtccctgaagatgatgacgaccctgagactttaatgatgaatgtttgcgacccatctgactcccaaagcgcgtcctattatagtctggatctgggcctgtacaaaaccaacccagcgactgtcttgctagtccctcgatgctgtcaagtaagaaaaggaactactgaccgcaagggaatcaatgatcaagtcagagaagcaaagaaggccaactaaggctagagccatcgcatagcacacatctacattacatgtattagattcctgtatcacactaggaactttgattcatcatgtaaagaccacaatacaagttgtcatacgaagataaaagagtctttattacaggctataaatttaagtatttacataaatcacatatgaaactactctaaatggtgatttccctgccgtgaaacgaaatttagtagaattcagtgttttaaacggagaggatgatacatcatcacttcactgtacacatgccatatcaatatatcgtcaaactaagaagaaccctacgacaggctacgatgccactggttctacaatcattatatttcagacaaggaattttcatatgagatggagttacccttacggtcgcataaataggacgcgagagtgtaataactacgaattgcctttgtccttctgtaacagtctgctcaatcctcttcctccctgctgcttgccctaataacacaggcgatggccatccctccgaacataacgagacctacgatgggattgacacacccgattgccagatagggtgcccccgtcgcgagcgaaatacccgccgtcaccgtaaacgggacacctccaacagttaatgaagcagcgcaaccacccgccactgcgccgatcgtggcgcaggtaccaacccccatgcctgccctcgccttcgccttctgtgatcggatgtagcatctattcgagtttgcctcctgactaggacaaggcaagcgcttcgccgcagaagaggaagaagtggtgggcggcccgaagccaggttcgccgtgcggcggcaggtgttggaattggaggcttatgtgtgggatgtcaggcagtggcccggacgcagccttgccaacgtggtgagggtcgataaagaacctttcaagcgatatttgcataggcatggtgccttggggaggctcccgcgccggccgctggcccgcgggcagggaggccttcgggatgaactttgatcccgagtacatcgaggcttccgtcaggcctcgggtaggattcttgattccgttcaagttgttgcagtgctgaacaaagtcctgacagtcgaactgccccagagagtacgggtgacgttcggtgcgtaatcttgcatctcgaggaaatgatctttgacggatcgccctgaggcccaatggtcgacatttttctgcattacccattcctcagtttcacccttctcgtttttcagcttgatccgaaggatgtcctgattcgtgatccaagatgaattgtcgcgactagaatcacgctgctcctcgtctgagaatctcacttcgggccgcggtgttagaaaaataaagttatcatcgccatgattgcccaaaccattgggtacgtaggagaagccaatgtttctttcgagaccaggaccgagttcatcaacaagcctgggtgctgaactattgccagggccgtaccgcacatccaagatttgttcctcagggaccaccttccgtattttgacatccttggttgcgtctgaagggccaagtcgctctaaaatataaaaatctgttccttgtcgtataaggagcgcgtcatgccgggcggggtctacgattacgcgcatcccgcccaacggcctactgatgattctggaattcaaaatctcggcattgccatgtttggtctctgcatggggcccaacgtttgtagggctaggttccgcgcaaggcgggacatcgtggaacgcgctgtcggggaggttgtttgtcaggcgactctcgccagtatcatcaagttcaacgagctgcatcgtccgagttcagacgtcgtgagacctgcaggtacaacgactagtcagtagttgaaggagtcctttgatgcaatactggacaagaagtacttactgtcgggaaataccaaagtgtatagcgtgaatctggtgggtcttctgagggtgctgaagctcgaagccgtcatcatggatcgttgctgtctatatgtttctctgcctggccatcaaccccgcacgttgggcattcttggaccagcccaaccatgcagtgctgagatcaggcagtaagctgatgggttaacgccgcgcgcgtgacatacgcatgatttagaagggtgtcaaggtccagcagcttgtagataataaaggatgccttagcgatctaacggagcaaggatcttgttaaggctgaatgatagctaactagagccttagcctatagtgggtctacaaaatcaaatctgcgaaatctgtttaccccctacataggcagtctaaagatacaaacttcaaagcttaaatggactatggccgttgagttcactgaccatagctgagccgaagtcgagccggtgcggctgacgaagatcatgatcacggtgcaccgcattccattcttctcttctctatctttgcagagccacattttatcatttgccaggccctatatattcgttccgatcttcaatcatcctacgttatttatctcagaatgcctctgactctcaagccaatcgacaatgatgaaactgcaccctggggcctgagtatcagtagctcagacttccagaagctgaagggcggctttagccctatatctatggatgataaatgggtcatcaaggctatggagccagatcagaacggcaacatcaccgtccactatgcccgaagctggacaggggcgcagttctacatccttactctgaagccagcagacgataattctgctgtggttgaaactatcacatggcggggtggtccgaatactagtgcgaccacgtcaagcaaacaggctcggaaggaaaccgtcattctttctagaatgttgcttggatgccagtttgaatcacttccacagtatgatccatcaattttctggaatccccaggatgacgaaagtgatgattaagatgactgtacttctctttgacctcatcgctatgtcattaagactacaatcttaagtggtagttgaacatgaggactatactggaaatgagacactcgagtgaaataaaggagggccctgagtagcactttcgaaacatagatggaatgatgctcgcgttaggcatcattctaatgaaggtcggtgatgcttgaattgatggtttagctatccgaatttgacaatagatcactctcagacattgtagttcagtttcagaacgaaatcatttaatgtccaagattatacgcatcacctgtgatatatgtcacaggattcatccaagatattttccatcaactttttaatagcagacttgtacaagggctcggtcagtgataattcagtaatggattgaagcgtacgattatgtattggaattttgcgaatttggctctcattgatgtttttctagttctaaaaacgatgatttctcaaagaaatcgtagatttatatacataatcgcctacttggatgcagttttcaatttgttagccctagatcagttccagtaaaaaagtctcgttctggtgttggaaggaatatctaaagctattaggaatacaagtatgctgaaatatcattcaagatccttgatctagatatgagccctgcttagtcgaatgttgaaggccaatcggcactcggagctgtgtcctcatcgcggacagatctcttcctctgtggtagattgcccggtgcaatggatctaattatggtttgttagcatcactgctgattgtgtatatccgagcgtgaaacaagacatacaacttttctagcagagcttctggtgatgacgcagagtcatgtagatccccaaaccatgcatgattcaaagcttgatgggatgtgggccgatcctttggcgaacgagccatggcatgctccaggatttccatacaggagcgactcacgtcttgtttcagtcgcccatctctcgggaatggccccttggccgtaacatacctagccagccagtgagggtcaccaaaagcattgcgattattgagaagccgaaacatgatggcgcccagggcccagatatcgactgcaacagtgtatatactggatgagtcgtcgccagctgggtgcacgcccatcacgtcctctgtactgtatattcccatcacctcgggagcgaggtacccccttgttccaactagagtgcgaaaagccgtagccttttcttctgctcgtttggagataccaaagtcaccaatcttaacccaccaatgtggcgatggctcagaaacgaggatattctagagtaattagtttaacttttgccagatatggtgtagaaatagtgtttggtttcataacgtacagcaggcttgaggtcacggtgtgcaaaaccattgtcgtgcataaagcataggccctctagaagttggaatataatctgcttggtttcttcctcgtggaaagggcgtgatagatatccttgcaaatctccatgctccatgtactccattgctatgaaaatggagtgttcgctctcgtaccaaccaagagactgcacaaagcaatgtacgtactaagacagagggtggaaagagtaagtaaaccgtcataagaagagaaaagaatgagaagaatctcaccttggagtgagagaatttggcaatagcctccaactccctgttgtaattgatagaaatatgttgtccctgtggctgtatcttggaaatttccttaacggcgcgaaacgtgcctccaccatcgtccccattaaggcgttcctcaagccagacacaaccgaaaccgcctccacccaactcacgcacacgcttccatgtctgttcttttctgagtcgtcgctggcgaatacgagggttcgactcgtacgaaatgtgttgcacgagtgctccgttattgctgatcactgtctcaagttttgagtctcggacgagatcagaggtggctgatctgctgctattgaaggacccggaaggagttgaggcaatcgaccttccagagtgtgactcatggttgactgccattcttaagctcttgtctgaatcctctctgccattgaccgtcggcttaatggtgcttggaacttcattggctggttgtgaagtcctatcccttcttttccttctcttccgcttgactggcacctgtgttactaaatcgtctgggcgtatggtgtcatcgaagtcgtcgtcttcagtctggctgccgtagcggtttttatgatcttccgtctcacgggactgttgggccttttgcctttccagaaactggcggcgcgtacaccccccagtgagctgagtcactttgcgcgacacctcggccctcagctgggcagtgtcgccgacgcccagtggtttctgctgagacgctatcacgaccagcatatagaaagcaagagcaaaatcggggaagaacagttctcctaactggtcgacgtcgcaccaagacaagatcaagcccacctggctgtcatctacctctattccccctcgcatcgcgttgtaggccatgtgtttgggcattgttacagctccttctggtacaaagcgccggaatatatcatgtagctcatcgtaattttcgcgattcaaaaaggataatccagtggcgtgaaggttttcttcgcttcgctccatgctctttcgaaagatcggcggtagcggacgatgctgctgccggggaaccgatgtaatagtctgctccgtagaatcccaaacggccgaatcgtcgttactattaccgtgatcgataccatgaaatcgttcctggccctcccatttcggcgtcacgggaagtcggggactctggtcgttatggaacattggcagattttcattgtgcttgttttgggcttgacgagccatgctgccggagcctgactcaaaggttggattggaatacattactgctctgtcgagcttgttctggctcggcggagatgtttggacttgtcgttgcggcaccggcatatcgtaacatctcacaagccagggaggtggcccatcatggtggtacaggcttggggctcgcacctcatcgaaaatccgagtctcatcctgtaaaagccatttaatgactccgagttcctctttgaccctctttcgtccgtactcgtcttggattggtgggataaggccttcgatctgatgaatgttctgcttggcccatgggaaggtttcagcatgtgccatgtgtagtagaaaatcaacgagctggagggttttgaaagtctctgtccagcttgtgataatgctgcgtaaacgatggtggagcatggtgagcaccgtgcctgctatatggggcctgggacatcacattagcccacttctgattagcagaacgagagagaacgacatagacatcgaagctcaaagtaatgcgataaggggaagaatatattccaatgttgtacatacccagacttcatcgaatcaactatcccattaaagttgtctaggacattgttggtgttttggttcggcgttgcgtcgataagaacttgtcgaaacacgctcgtattaatatatgtggcaggttggaacatcatgccggggttaattggcgggtgtgtgacaggcatttggaactcagttttggattgtattggtggttggttcacagcaggttgaaatacagtggtggattgactcggcggctgattgacgggaggttggaatgcagtactgggttgactcggcggcggcctcattacaggcacgaattcagtgctgccttgtgtttggggtcgtttatcacctcccgagagattcaactttcgctgaaaccaactgcggcgctgctccatgatgctgatctgcttacgcggaaggccacttcggtcctacaaccatatgtaggagggacttcgcggtgtccttggtggctatgaatctagtagcacgcttcaacttgttcggtttcgatcgtgaggtgataggctctgcgtataatgctaaacctgtcgagtccttcttcatgggcacacgaattcatcagagagagcgtgagtctggatcaggagagggcggtagcatggcatcgctcagctcggctaagctaaatagaagaggggatagcaaaggcggctaaccacttttctctaagctgggatggaaaacgcctcattattcaacaaaacaggttgggctgatttatgaccttatgcgaagatccatgcccaaggcttccctaacatacctatatacggatgggttttcagcatgctcccccgaaaccaaatgtatctcaaagggtaatgctttgaacgaacaaatacggaaaacaccggtgccgttttaaattgaaacaggaaacagcattaattaattttcaataatatggcctagacagtagccaccgagaatggatgagcatgaagaactccaaaaacataatgtcaatcaaagccatactaagagttgcaatattcctcaagacagctggagtatactatgccctctgaaccggcttaaaccgaacgcgaaattgcggcttatcccagaacgcaaggaacttataatctttctcaaaggataggtctcgttgatctgctccaaagtctagatcaaattgccataagaccttggccattaacaatcgaaccgtggctgaagcaataggccctcccggacagcctcttggaccctgactgaatggtctagaggccttaaggttgtcgtctttatatatgggattgaacttcggatgatcagggggcagccagcgttcgggccgaaattcgagtggctctgtgaagtatcgcgggcttctagccgctgcaaagtagctgatctgacaagtaatctacccaacctctccagttagtgtctaggcaaattcgtcggcttagggatagaggatggacctactccttggggtatatatgttccatccaccatagcaccagggctaatgcgcggcaagccgtcagttgtttcttggtgcagtcgaaagctttcattcgcacagctctgcaagtacttaagactttctatcgaatccaactttatcgcctcatagtctggaaattcttccctaacttctttcaccagcgttgcataggcatcgggttccttgaggagtaataggatcaaggagtagaactgattagccaaaggttgccagctggctagaagcaactgccatgctacgttttgtagatggtagatttccttctgatcctgaggtattggttgattgactgggactagctgctcgaagtaatccaaatgctctatgttgtgccgctttttcagccgcgcctgaacatcgtcagtgttcaatttcagaagttcaagcatgtcgaaccagacggcaggagggattgtcaaatatgccaagggtgtcaagaggcggaacttccgcacgatctggctcatcagtatgaacatgttcaacttgaacgtagaacgaacaagcactgagtccttcactaggttatgttagcttgatttcccaacgctgcttattatgcagctgtttcaaccactcactgtctctcaaatggcccatgtcgatgcagtatgtcatgtccgcagataaatccagccccaaccactccacccaacgtctcatgtctgctcctttctcctcacctccgaaatccttcatcctattcacgaaaagatcaatgtgtttatgaatagcggcctctttggccctcaggttcctcgtgctgaaagcaggggcaagcttcttggcaatctcacggtgcctcacaggattagtttctcctgaaatcccgccgtcgcctgtgtccaaagcgtcgtagccgacttgaacgaagagttcgagatttttctcctgtgcgagatatatgtctatttccacgcagtttcaatcagcgatgccgcgttagtgtcgagggctattgaccgggcctgacctttcgctgcctgcggcgtgatgaacacaagctcgtttggagcaatgcgcacaacgtctcctacaaggctattagatctgcacaatgcaagctgtcatgacaacgggaggagctatatcaccataagtgttcaggatatcctcgattatccacgggtatctgcccgttgtactagtgctgtcagcgcaaggtgaagcaactcattcatctcggttagttacacacctagcatatgcccaccacagatcagtgacggcgccaagcttcggccccgggtatttagagagcgggtggaagtagaggttgtaaatggctcgaccgataaaataagccgtcccctagacgcaaaaagtatccggtcagaacatgatggcctgataggcatttttcatcgacgatttacacggccactcaccaatgcagcaaaagctggcagaagatgactccaagtcacgcttctgcctaccgagacccaggggagacttgtgagtgccatgatgctcctttgttctcaatcccatgagagatgctaacctccttttatgccacttggcgagaagcttgaccaggggagagagtcagactccacagaattaggaacgtgaacatgcgaatcgggctagtcagcgtaagcaatgaggaattatggtccgtgccttcttagccgtaaaccaatgagtgtggagataacagtaatattgcaaaattatcgtgacaactacataattggccccaaacacgctctgcgggcatctgctttgtcaattcatcaattgtcttcccgcgattgcaggacgctactaaaatgtgcaattgcacaagtcattgttgctcagttaatcaatttccacgtttcgttgcctcaaggccgaggtttgcaaatggccatgaacggcgaggccacaccagacaaaaacagcgttcctgactttgcatcacgaactacgattgttgtcgtagggaggattttggcgtctcgatcctcaatcagcttgacaatgttatatgctccaatcccctgcccttgtgactcagaatctagtcgtttctgaagcatcagagccgtggctggagcattaactgagtatggcttttccacagatgccggaaccttcagtgggacagggaaggcagctaccaggacattcccctcctcatcgaccgaaagattgtccacggtcatcttcacattgatttcatcaactttggaaagagtttcgccagagagcttatagacagccacaaagccgcctacggaatgggcaacatagtacagcccatcgctgcctctaacgattccattggggaacttcatatcttggacagcggcaaaattgcacttcccagtatcagactggcaatgcacaatactcccgccgcccgtaaaaatttccaagtctcggaagcgtccaaccttggagttatggtcgttcgttaccgcgaaccctatcgcgtctttatccacagtcacgccgttgggtgcaatgatggccgggtcgaagactgtcttgacgtgttccagctggtttgatttgaggttcaggtcgaatatttccacggttgagttggcccccaggcttggatcggctataatctccccggtcgtttcgttgactggcggcttgtgattgatgatccaaaaccggagacggccattgactcgctttgcatcaaatccatgcagatccaaagtgctggtgaagcctgctgcgacctccacctttttcaggccatatagaccatcggccccaggctcgtcaatgttcagcacggcgatgtgatcagaaccggccctgcctgatacgttgtacttgttgccgccggggctccacgcgctgcgcgactctggagttgtgcaggccgcatacagctttcgcgactggtggtcaagccagagatgttcgcacgcctgaaggtcggtgtgctggagcctctcgcacgagtagtcaaaatcttcgattggcagagcggtgttgccaaggccgaacatcagcgaaacggtgttatggagataggtcttgtaaagcacggacagtgcgaggatgagcagagcccagcggaagagaaagtgagccacagtgtccttaggaccctccgcctcgggaggcgttgatgggaccttggagctcttttctgaaggtgccatgactaggtagttgatagttgtatcgggtccttgaggcgacctacaaacatcagatggcgatgtcatcgagcagctcctctacaaaataaatagcaccccctaattccgcgcatccgtattacccgcacgtgcgcacatgttggagcaggattcaagcgctagttccgactaggactaggtcagtaagcagacggattcggtgagaatgagcgctgctacaagcccatcgtattcattgagttgagttgtcgggccctggcagctttcattgctgttgaactttattccctttctcctacgtaacaagcccatcatcatgaaatccagatatcctacttcaatgtcagaagtatgtagtacggagcaggccatcaccaaaagccaaatacgaataaattatcttagcatggtttatcttagtaaagccattttacgaatcttctcaacatagattcatgactcgcggtgggttttgctataatttagcatctgatgagagcatacgaagctgtcgggctcaataagagtttctgattaggaagaataaagatgagtatctgggaatcaattattgaaatacaattactccattcgttttcccttcctttttttcccttctttcttttcttttcttttcattgaaagcataaagatcaagccatgaaaaactcaaacagactactaatccagtctggaatgttatctgctgaggccgccgcgatcaaactttattatggtagaaagggaagcaaaactggtggctcacgccgagcccccactccatcaaatcatgtgtcccccgcaaagtctacagaaagggccggaggacctcttgcgtatacacccaagtcttctcccgtgctgtctctctgagatgtccaaggaccttctcgttcatactagcatcacagtattgattcaccaaaaacagcccaggaccattcccgcctcgtgtattcatcgctgccggcaagtctgcagggacaccccgaccgccatatagagcgcttgtactggcaaagagatggcgctgagccgattccttcggactaagtccaataattttgaccaggggcccaaccacgagccgcatagcccaatgcatcagcgaatttggcgccacgtcggatgtcatgttgttcccagtgttgacctgccctgggaaggtgtgaacgaaagcgacatcgggttcttgttccgcaaatttctccatgaccagagtgttcatggcaataacttgaacctgcgatcggatggcaccgtaggcacctggctttttcaactccaagtcgtccacatcaatatcggccttctccaaaccgcctcctttgatgctgacaactcgcccgtttggagaggccctcaggagcggaagcaggtgcgtgatgaaggccattcttgaaaaatgctggagcgtgaaggtggggtcaagcccttcgcttgtttcctttctgccgttgaagggcaagacccctgttgacataaataaaagatcgagacttgtctccttagattgtatctcggtgcagattttcttgacatccgcgagaagcgatacttctccggctagccagacaacctctgcattggggttgacatgtttgagggtagcgatttgtgttttggctcgctcactagaggacgggcgaccgatgaggtaaattttggtttcaacacctgtttcaaccaattcagaaatagtatgttggcctataccagatgtgccaccgacaaagacagcaactttgggtaggttggcacccttgagttgtgagttggattgtttaacaacgtccagggcgaccatgatgactatttttattggggggaagggggaagtaaaatagtaatattactcttataattcaatgagtaaatttgttataatgaaaatttagtaaatagttcaacattgtaataaagaatctgtctattgtatcacaaatttatgtcgagttcatccaaagatctgggccgttggttatcgataagaagacggcggaactccgccaggcacaccaaccaatcacaggagcgtcgacactcgaaacatggagatctcattgggcttcatccctgaatcggaatccgagctatcctgattggcccggtcctcgcaagagtgcctctcatatcaaccgtttgctctagtcaacccacgaacattttatttatttgccctttacgatacgtaacaccaataattaagaaatcgtggcaagcttatggatttgttcctagtttgtctatgtccgcctcagaatggtttccaactagagagacgaaggctttgacttcctactgagaaactttctctgagcatccagagcgagaataagttgatgtgcttcgcagaccaaattcatattctcatcacacagggtgatgtccacccccatcctacccccttccatcatctttgtttcagtcctagtaaagacccagcggagcccctctgcaggaactcgtcttctgaattcaagatttagagtaactgtctgactgaatcttgtagccttcatagcttccgcaatcgtgtttgtcagaggtgtggggatgcccgggtgttccttgtcccattgctccattttctcgtaaaaggcatgcgcattgtacatgccttcacccataagagaatcacatacagcaggaatgaaatcgctcaagagtccaaaataagtagcatccatacgctctccatcccggaaagaattccatgcgtcgtatacgccggcagtaggaaagcccccgcgagggtttaggcataaagagcggcgggtaaaaggaagcagttctcctgagactgtagcaggaatccagttgggctcaggtttatgggcctctacaagggcaaagttgggaatcggttttggcggtggatgcagagtccagtcagtgggagctgatgggccgagtgtcttatcaaagttggtcgagttggcaatggcaatggcatttggacgacttttcccaggggtgccgctgtcctgggatagctccaatagtagagtgcttgtgctggaaccggtcctaagtgtggtaatcgtgattcttgtatccttgacctcacaagcatgcagaaactcaatatgaaggctcagaacatcgggctgatctcgggctgcgagtgtcggatctgttgagaggtgcctacgtgcagcatgcatgaatacagaggcaagatgaccgccattcagggctaacgtgtgttagcggtgagctttgatctccaatgaggtatggtatgcaggggctatactttttccgacgacccaatcatggtgccaggaagcagaatatgtgttggatgagatctgttgtagacttatttgcttctgcaggatttcggtcatggttgaggtggttatcagtttccaacagtgctggcttattgaatacgaaattttgccgtattgagatttaactatcccggatgatgacagttatatatttttcaatcagcctgagtttagtaacctaaacaaggggccttttttatcatcaacccttgacatgtagcctaagcaacagcttacgttcccaccaaagcgccaagcacatctatccatcggcttttagcagcgaaattcatggataataagcttcctatttagtctctcaacgagaaagaattcttcgatctacacatctctaccttgtgttattgattatttccctgctaggcacgcaaaggactgttcatgcgggggtatagttgctcggctatagggtagggatactgttcgtgcccaaaacatagtcatgcgctgacttatctgagagagacatccgccgccccctttgttacccttgctagcgcgacctcgtgcatgaggaagtgggagtcaccaaatgcccaatcgtctcagaagcccgaccgcgaggtcagtgaggcggtagtggctgctctctgtgccaatcatgagtcgacaagcagcaaaccgacgtggcgcccgttcttcccacgtctccccccatctcccatcacttgaacctccgccggaaagatccagaacctcttttatgccctttctgcagcttctcaccgagataatccaagcgatcgcgtccaaagtttaaacctccggctggggagagatccccgtgttttccggccggccacattcattcatcccttggtcccctctcaatcggaccccggtttttagtaatcagatcgccctggcggtgtacgatcaatctctcgaaccaagacagcccttcggcttcaaactctcattcacaaattatgggcgtcaaggaggttttgcccatactccagaagaacaaggcggtgcgggaggccgccaaaaagttcgcgcaggccgccacccaagccgctgcgggcagccagtctcccgtcgtcaagctgatccaggccgggtacggcctctacagcgtcggcaacagtatcagcaggggcagcaatgtcgaggagaacttgaacgctctgctccccaaggtcggcgatgtggctggggcggttatggagttcatcccctctatgcaggtcatggggaagtgcgtctgcgacagcgccaaggtcttcacgtctttcagctctatggcgacggtggtcggtatcggcgccaacatcatcgtgacctaccagggtgtccaggccctcgagctgatcggcgccaggctccaggatatctcgacacacctcgccgcccagaatgctctgcgggcgcagagggatttcccgggctatgtgtataagatgatccagcagcggctgggcgagacgatggacgacgcggcgtgcgatcactggtttttcctctaccacccggacaatgactggtatcccgagttctaccacctcctcgagaagaaccccgttgggcctcgcttctgcggctataccaaccagattgataccgccttcgtcttcatgttagcgacaagacggcggcaagtggagaaggagaggagagcccaggaagcaggcaagtcagtacgacctgtgaggatccacctcctgattccagcctaccagcccatcctcattgccgaaccactgcgaatccccagagaaatgggcgactttgtcatggagggccgaatcaactcaaacaaggaattcgtttggttcaacttgccccaggaacagcgacaccacgtcttggacattggtctctgggttcccccgcctcaaggctggtgcgactgggcattgtcgagtatggggctaaaagtcccgccgagattgatgccacgaagagttttaggccaaaggcagaaactgcggctaggcaaaggaggagagatcgaacaggttcagggtattgacggggacgaaggcccgtcttctgctgtcgatatttctcctgcaggagtagagcgccgtagtcgtgcgacggcgctggacaggcgacccaggaaacaacggcgtcgggcacaaagcgagcaacctaaagctaaatgatgaatggaaatgacttcagatgttagagttatgaataatggtccgaggcacacaattgcccacacaagaatttgacagaatattacttgattcttatcgagaaaactgccctctcatcccaagatgcttgcgctttttcatttgcatatgtagttgctaacatgtgatgatgaaatgtatcataagccattctaggttttgggaagaaagcaaacgtagtcgcccctctgaccgcatgccaagataccccccgtaaccctcatgcgtaactttttggcgaattttatgctacgcttgtgagattttgttcttccattatcgagacgtttactccttctacccgtctcatgcgttcctgaagcgctaggatggtcggattagttcggagtcctgtgtagatggcaaggaaggctcccaattgcttttgaagtgctactttctcaaccatggaacctttaattcttgtctcgatgtagtgctcgttggtaagcttactacggagcgaaagttcaaagaactgtcgctcaaagcaattggataggagtcgagagatacttccagcatcagggtggttcgatttgcctgctatcttagcaatggcattttggagatatttccggtccttctcaaatgtcatgttttcttgaacggcattttgccaacctggtatgtcggcaataaacagaggatgatgaatggcagctggcatcgggacaaactgcgctgtgtcccagtcgattactctgtcgacatcgtgccttagtacagaagcccgagacaaaacaaatagccagaaacttacccagaaattccttcatcatccatcaacacgttccaagcgctaaaatcgccatgcttgatggctgcccgtgggaaggaaccttccggaacaagatcatctatggtggctcgtcgttggagaaaagtgatcagatctccccagcctggatcgccttctaatgaacgaataatcgctaagtcaacctctgactgtagccatctcttataatcgatggagcaaacttcacaaagactcgtcagtttgtccaaaacacaaagaatagcaatgggaactcaccacctcttggcacaggacaagtccacatttcaaacaggaatacagccaagccgtcaagtaaacgatgccgcctctgatccgagagcttattggagtcccaataatcaattggctctccgccaagatactggaaaacagaatattgcttcgattggcaaagaagtctgggaacctggagcatcgggcgcttctctttgagatatcgaaggatagccgttcctcggtcactcagagaagctgcgaattcattcttggcgattcttatactccacgtctcaccatttgtaggatgatcgatgagccagacataatgagacgcgcctgacataggggaatgaggctgcgagaagtctacggcgaaagcgtttgaaagttcatggataatgctgcccaactctgaggaatctgacatgattgcggtttattgtgatgattctgtgcattaacttctatccggccgtctcaagggggtagatataggtgctattcccatgtctaatgacgacacctgattttgaatgttggcggctgggcggggcgatatgctgcatgaataacaatgctggacaggcaaccgaaggcccgcatgaatacatgtatgcgatcatatctactgcacgtttatgacgccataagattccagctgaggttgccgggcgtcacagtgagattgtgactggagagctggccctgtggcggaagtccaataattagttgtcaggcaacgcggaagaagtaattgagaggaatcgagtgaaaacccaattgccctacctgagatgcgatatccgagtaatgtaaagattattgtattgcttctaattcatatgcccagtcctcttgtcatattctcattgcccattagcggacataccactcttggagcagagctgggaatgggcgcattttcgttacgagttgaaacgaaaggcggacttaacttgttacctccggactgctaactctgtgacctccggccgagaagatgaacttcctccgggttggcagatcattgtacgatctaaatgtcgaaagttccggaagaaagcctccagttgagaagtgcccggatctttgcgttatgatctattacgtgttgtccgagccgctcggaatttaaagcccagattaccggcggcactcatagcgtacactggggtgttatgtatacgatatttcgttcggtagttaaaagttactgctgagtattgtgctaagtaaggtagatagtattagctggatggttattcttttcttttcaaaaatgcgccattgatctcgtcataggaccatacgcggctatcagaaccacaacaacacatagaatagtacgatcccaatttaatagcgattgaactttattaatcgcttacctttcggtttctggactcaaaaaagggaaagaaagctggtaaaatggcttgtcctgactgtttccggggattcgccaacgataatgccgcaccaattggcactgagattacacttcacggcattcgaacttattctgggggacacttagtacagcacacttcatcttctactatcatcttctttagggatttctccggccctagcctgcttagcaatatgttacttgccgattacttcgctgcacagaagggatgtatcgtattggttttggaccttatcccgggaggagccatccagccctcatgcttcgagatcatggaccccgatgtcacaccagttaatggtcggatatatacgggcacattatgcgcttctcagcgctatcagaatgctcgggctcttccttcccattgcgctcggaaaaaagactgcacatccccgtgttttgtcttatacaagagctgtgagagccaatttgctggctggtgggaagcttggagtagcaggttattgttggggcaacctctagagtacgaaactgtcacaggaagcaaccactgaagggggcagcgataggcttatcgatgcacattacactgctcacccctcctcgctcagactgccctacgatttgatccgatcagtggagaagctcaaggtgccgctgagcttagcaaccggagatggtgactttgcggtaacaccagagcgcatgttgaaagcttgaggcagcaatgttacaaaaggttagtgacggttatggggaaattgcatatgagctcaagacatatcaagattgcaagcacggctttgcgataaagagctgatcgccaacgaaggcaagaggatgctgcggctgatgcagctgcagtccaatccatacaatggctcagacattcctgtaacatcacagcaattggaagggcgtcctggcatcttttcattttaacaactaaagacctcttataacactccggtctattagttgcaaacggcgagtgactctgttgcttcacatctcggccgatattccttccttattcgtgtgacgcttaatgtgccgtcttcacaatttgatgacgttcttactgctagccagttgcttgatgtacctatagatgcgtctcaaaaaatcgagcgcgaatgcagtttcgatttgccttccaccctatttgatagagaaatgtccaattatcccaccgccgtcttaaggattgacttctatgtttccgtagcgaagcttgtatatataccagagaaaggcgatgcaccaatacacacatggtgaggtagattcaagtcatcgaataaagaggaaaagttgttatatcttcacagtcaaagctaactgcctaagttgttgtgcgccctaggctctgagttaacgcaacctttcggcggatttaagaacgctctaactccatcgagtacgctaaatgtattcaaataccgataacggatcaggtttcccctacttcctcggacttagaagtgattctcggagccatttgcatggaggtagagttattagttgtcagatcatttacagctgcagcatttagcctgagcctagtcttttataaagctaactcagagagtactatggcgaattatatagatctattaattcactatacttaacctgcaggacgttgaaagagaatttacaatttatttgccttcgaagatgtctgaactaccttactcggcacaaacgatcctcgtgacgggagccaacggatatattgccctccatatcatcaaacagcttttggacactggatacaatgttcgcggaactgtgagatcagaagcagctacggaaaaagtacgcaatgcgtttcctcaatattgggggcgccaactcgaaatcgtgcgtgtcgccatcttgacccgggccgattcgtatgtacaagcccttgacgataagatcacggcagttgtccatgcggcgagcccagtccatggcgctgtggaggataatgtctgcgacatgcttgagcctgcaattcaaggtgcaaccgccatcctctctgctatttcgcagatgccatcctccaattgcaggcgcgtggtacaaatgtcgtccttctcagctatactgaatccggcaaaagggctgcggccaggttacacctacacggacaaagattggaacccagtcagctatgatgaggctgtgactatccagaattcatctgatctctaccttgcttcgaaggcactatcagagcgagccgtttgggactgggtcaagcaacaaagccctgtatttgacgttgtctgtctgaacccatcttttgtcctgggcccgcacgttgacaggatcagttcacccaacaccgtgtcgactggagctatgctctggtcgattattgactccgagtccattccaccacttctgtttgggggttacgtcgatgtgcgggatcttgccaaggttacggctgccgctttggagatcccagaagtggccggggagaggtttttggtggcacaccacttcgattggcaaactgcttctgacttagcaagagagtcttttccggccctaagaggtcgtatccctgtcggcgatcctggtaccggcgaggctaaggctctgaagcatatctaccaggttgatggaaccaaagttaatcaggtgctgggcattgaacttcgcccactgcgtgagacagtgagcgactctattcaagagttcattgagttggaacagagaccgcgtgcggcaacaccttgaattgtaaagatcatggtgaatctggaggattggtggccttgagttggtgtggacatcataaaactagatcattatggttgagacgcacaaatactaagccgttcttgcgcaatagcttcttcaatgacctggcttagggaatatggaatgtgtgatatgagaatcgatttgatagacatttatcttattgtagtggccggggctcttgcgtgccaacagagcgggtagtttcggacatgaggtagaagagatgtaagtcgagggacgtaggtggaagactatgatgtcggcgtgcgcacctcaccatcaacgttgtcaacaaggatagcaacgatggtgcagtcgatatcgtggtgcgcgaagatggctgtaaagatgtctgtgtcaaggcgggagcgcccaagcattttcacccaaggatatgacctagaattctcaatgatgctggcaaggagcaacgctggacggagggtgtttcagctcggcaaataatctacgacgggaagcctgtggagcaacagttgtacaatctcaagtttcggactgtttagcaccactgtcccaaggacgggttttagtatagacgtttgggcctagacataacatacattgattgcggcaagtgaaatgctcgtgcaaggagaatcgtattcatgcttgagaaaattgaaagttacatcggatgctcaataaccaccttttccaggctggcatcaccccgggaaactctttctatttcgctgagaccttccgaggcccctttcacaactttaatcactggtattttcaacctagcaccggcactgtccaggaagtaatccgcgatctgccgtagtcgcactggagcctcgggatcctgggggcctccaaacgcattcttgttacctctaggacgataagcggcacacattttgaactcgggaattgctggaactggggctgtgctaacaagtctatactcgctcgggtttgcgccatccgacagagcacttctggcgaggcccggggtgctctgccatacagcctctccttgcgcaagactatttttgccgatagtatcgaaagcagttgtgagaagaactcctttgtcattaacagcggctcggatatcctccaagatagttgggcttttgtagttaaagcatcgatcggctcctagacgctggaggatcgcgtggtttttgggtgacgctgtgacgaagatgggaccaaaacctgcggtcttggccaactggatggcggccaccccaaccgagcttgctccgccccaaattaggatagcacgacttctcggatcgagaccagctacaccggctgcttgaaggccgaaaccgagcccgttggataggccatcgatagcggtatgagtagccataacgaggccaccagcgtctttcgcgtcgaggccgtgaggcaaggtgtacaacagctcactttcggcaatgcagagatcctggtgagagcccgtagaggacggcttcggtagctttatcggggcgagcccgcaaacgttgtctccagccttgaattgggagagaggtcctggctgttccacagtgcccgaaaactcgaacccggtcacaaaggagtgtagaccaacatgagcgaagtttatatcgcaagggttgacgcccgagtacaagacccgcacaaggcattgagaaccctctgggatataggtctcggagacatcatggatggcaagcttcccgtcggatccaagatagagtgatttggagggcgtatcagtcattttaacggtttagtattaagaataagttatggaatatgatttgggcttgaaataattccggggctgaacatgcaacttatacaactacggctcttgaaggcaagtgtctggagtagtgttccttacggtggcgtgcccaccgttcctgccctttactcgtggaagtgtctgcagcaaatacgacatggaatattggctccggacataaccaaattcatcactttgaggtttgatgtgtcggaactgcgtccatggatctgtatgcacgctggggataagcggccgaagtagtggtgggtcaatttgatatgacggcataagcgccggaattaccggccgaggaaatgtggagacaaaacaaccacaaacgctcttgaatgcgagcgctgagcgcctattttcctttggaaactcaatggctgaacttaccgcttgaggagctgataatattaatcggtcctggtaaattgatggatttcatcctagcttttagcaatcatgatgtcacatacgggaatgggaatagcttccctttggtccgacacacataacgcaggaacaaatacatagaaacttggaatggaggaggaatataagagaagtttttctaggagcgagtgaaatttggtctcttgctattagattccttgagctacctatagccccgaggtatcttgtgtaatcctccacattagtcacgtcacattgggcaaagccacccaaccttcagccggtttaccattgcatagatggaagcttacaaacggcggtcaggaacacccatgaagccgctaaagtgagctaattcaaagtcgtttgacacaccattctcactgctctcccagttccaacatgtccgatcataagacattccttcaacactcgttggtaacgggacagcctcacccgtcgccgacagtctggttccccgatcttgttggtctctgaattcgcagattgcggtatcgatgattgatagaacgctggagctgtccttgttctcggaccttgcttgctcagcctgaatcactgctctagcagtttctagcagagctagagtctcggacctgtccatcgggctttcatccatgctccaattagttgcacatagaacgaggcagagagtagttgagccgagtagcaagtcgcgccaggtgatgctcttcatgaaccactcttctgtttctagtcgaccgccagttgtgcattcagtgtagacatctgtgatgatccgtatgagggcagttgacgcgacatagcactcccggatgctgttggctctaaatttcgatacatgggggcggtgtaagacgcagagacatttgtagtatatgagtgagatgcaaagacgggtgacgataagttttgatgaatcaatgacggagctattaagaggccgtgttcgatagatatctggcaaggtatcatagatggttttgatttcaatgtctaagaggtcgacatcgtcatctgttggcttttgggtgctagttagtagtacctgttggagaattttctcaaagacacccatgaatctttgtttcaagatgcagaatgtgacacctgtaaactcggtgtctggtcgggcggtaggtaattgaacgctgtcctcatcaaagtcggagtcgagaaggttgtttggcgcttggatgttccaagccgagaactgaacactgctcgggagtcccatatggaaggagatcaggagatcaagttgcgcacatacggaccaagtcctgcgacgcatctccttcgcgaaaggactcaggccggacgcaccatcctccctgtgataacccgccgtcgtggcaagacggacgataatgctaagcagagatcccatgaatggtgggatttcaagagaagtgatgtactgcgactgtgtgtatagcaatagtgcttcaatcgcaaaaggtttggggagaaaatattcgcctagagcaaggcactgagcagcggcttctgcgaatccaaccctgatcctttcgatatctctccacattgtagcagtcgtagcagcgatatgaaggatcgagaaaagaattgagatccaaagtgatgacgtttcgccgggcgtattccagaaatcacggtattgtctctgaaattgcgaggcatgaatgaacggagcagcagcagagcgatctcgaaaatatatagaaaccaagcggtccgtgtctctctgcgacggaagatgcctcttaaggatgtcttcgatgctaagcgtgttcgagacatgagttccaaacataacacctatcccggctgcggctctaggagtgctgagcatcgcatccgtgttctcggctgcaaatgtcatcaacgtacgtctaaaggcctgtatatcttctagcacagctgaccaatgtgtcatgccgctttggatcagatgggaaggactaggagcatcaagcccgccactggatagtccaatggcgccttggccttcggttggtgtggtgggcagagtgtcgtcgttcgccgtgacagtggcctcagtacgctgcctcacaagtgtctcaacgaggctttccagttgaccaaggcgtgagtatgcatgaacacgccactctgggttgttgctggtgttgtccgtgccatccatattttcggcattgtcgcttgatggcccgtaggagcagcatgctgctgctcttctgcgtacacagctgctacatgggacactccgatcacattttagcttccgctgccggcacggcctgcaggccaatcgctccctgtttctgcgtgttccggtgggacggctcgtcttccgaggagcggaggacatggttttggtagtgcttatcgttgcagacagcagagaagtaggaacgaacccgttctgttcccgtccgcagatgcgccaatttgcattacctgaaaagggacagaaacccctcccacgcctcattagtaatgatccaccagcacgagtgtcgtggaaagtcccgagtagagcaagtgttatgagatgcgtgggttaatatggctataattattctaattatatttaattgatatttagtaaccctgttctatcaaaagttcttgcttgcaggaccaatgttcgttttaagaaaattccttaaaagagctaggtactagtacttactgatatggctcgtaacctgatatatcgaagtacttatacttccttatggctagctggccacaccaaggtctaggcatgtctaactcttatagtacttgtcgtgatcagcctgttaattatgttcgttatgccttcaaccatgaccttaatagacatggccttgtcgacgttaatggtgaatgaatatttaggtttgaaagcctgattttagcatatgaacgactggcttaagatctatgttttgttcttctccgctattgccatagcaagccctttagttccgggtgaacggtaatgcggtgtctcggaccatgaaacaagcgaaactatatgtagctttgacagcgatgcatattatacataaatgatgccaacactctaccagtggtggtggttgttggaaacacgattcagaaagtgagaagccaagtacaactcaagtatataggttctgatttctgacctgcatccgctagtatgttagattcaaaggatgtcaccttagacttggttagaactgtagaccgtactgtggtttacgtgttgtatgtttctaaaggcaatttgatgtgcgtcacgttacttgcggatggagactcgcatcttctaacaggcctaggtagagtatgccatggattaaatccatgtctataaccggtcattggatgaagtcgccggatccataagatcattggaggaacattgatcttatggccgcggtgaagaaccacagcggacacacatccctagggtgtgtatgagcattgcccgatgccaccagcatctggaaatacgattcctaactccgctcccacggcattccactcctggccttagtcataggctcatcggaacacactggcaagcatagaatgtcactctctggtatcagcagtaaaagtattaattatgtctaactggcacgcattcagacgctgtacatctagaagcaaattgacaagcgaattgacaaacaactttcaacatataactttttttccgcatcactagatagtgatcatgtccgcccaactcgagaaagatgtctcatgggagagcagcatgctcggcatagtctacaggcagcttttcgtctccagaaagcctctaactaatcacatttcactcaatggacagaccgctgtcgttactggctccaacggcggacttggcttggaagcgtccaggcagcttttgcagcacggcttatcacgtctcatcatggctgtccgctcacaagcctctggtgatggcgctgctgaaatgctgcgcaaggagtttcctgatgtccatattcaagtttggcttctagatatggccgactatgactccattcatgcttttaccaaacgataccaggacctaggtcgcgtcgactacactattctgaacgctgccatgcagagcagtaatttcgagcaccacgagaagacaggccacgagctggtcttccaggtcaattacatctctactgtccttctatgcatgctgcttgcgccaatactgaaggacatgacttattccagcctcactgtgcaaccgccagtgcttagcattgtcggatccgacaccatgtatttcagcaagttttcccccgctgggctggtatttctccgtatggacaacccgggttcgtacgaaagaatgacacaatacatggattcaaagctgctgctgatgattttcattaatcgactggcgcagcagatcgatccggaccatgtgatcattaacgtttgtaacccgggcatggtcgctggaacaggtctgggaagaaatggaagtccgaaccctgggtttgccgagaagtatttagttcctctgtttgtcaaggctctagggcggagtgttcagtctggcgcaagtgtatatgtccacgcgctgttggatgagggcaagaaggggcatggcagctttatcagcgactgggatatcaagccgtatcctaggctgatgtatgtcggcgagggtcaggaactgagcgagcgtctgtggcatgagacgatagaggagcttaaacctgcgctgggggaagttatagccatgtattcataaagacaacggcaggactgcgggtatctcacgggaatccgataacacttctatcgagcaagtgatcagagatcacggatcaagtggcaaatgatctactttaactggcaatgaatggtctttctatcaccgggccgacgtagagactgtgcatgtacatagacgtaggactctaaggctttggatataggaactacatgcaacttgcaaaccctgtcgatttctgattataacgtcgaagccacggtgtctcgagcacactcttcgaacggctgcaaagaaatctgagtttgcttcatcaatcatgccaacgatcaaggagcatcatgagagtaacctacatagctcccaacactcggaaactgcttgaaatacccctggttgaggtatgcattcatcaaagctacaccaatctataaatttgcaattagtcttttcttttcttctatacaagacgacgttgctttccttaaaaccttcacggcagttcaactttgttcccttcacgtagcggctagctcataaaatacgatatagtttgatttgttaatgaggccgcttgctcgcagtcagcccccctcttcggatcaaaaagcatgaggcatagagcggcggagattagcactaagcccggtaacgtgaattgagatgaagaaaacgtgaagttcggccgagcactggagcaattggcttcccacaattttgtcagggagactaatgaatccgatgtctgtagtccctttttatttgcctctggaagacattgaagataaattatttagccatgttccccgcataaactccatttggggtccattgtgcttccaatacttgctgaagcagggtttagatgattatcataggtcatccccacagaatgatgaggctcttccacccaatacagacttcaaaatagtagactacaactcgttggacagcctactcgccgctttaaatggtcaggatgttgtcgtatcgacggtgaatcaaatggctgttcctcagcagaagttcataatagacgccgcaatcaaagcggaggtcaagcgctttattctttagcagcatatcgcgcgacccaagtgcagcacatttactccacaatgtccaacccgtcgagatctagaactacctaaaatctaatgaagacctcattgagtggacagttttcagcagtggtgccttcactgaattcctcgtcaactttgatatcgctttcgactagcagaacaagagtgccgaaatttgggaggatggcggccatcgtgtcagcacaacatccttggaaggcactgctaaagccatcgcagctgccttgaaagccccgaccgtaacaaggaaccgcgttctccatgtacacgtaccttgccgttacgcagtctcagctactggccctcgtccataaatactcgcctggcacgacctggaagattgaaaatattgacaacccctctgaagagatagaaaggcttgagaagatagccaagcagaatcccgagcccgggaaggttcataagtttgtaagggccaatttgctcagtggcaggtttcaagccttctattagcaagtagataacgaactacttgggcctagattacttatcgaagttgacctggaggcgaagtttgcagcctcgttcggatacaaaacaacattcagaaaatttttatatttttcctacgccaggatagaggtgttttaaggtcttttgaactgtaattagtgagcgcatgattaccagtttctagtttatgaagaggagtagacgaatcacactgttatgcgtgcaagttgttttaccactaaatccaaacgtcgggttggtcgtgacggagcggttaggtactacggccgaggtctgaagaatacggccgtgatataaggattgtggggctaacagatgataaacatctcacactgggtttcccaccaactagaaacggtgctggggcgatttggcaccatactgatcccttaacgtgagctgtgaagaggggaaaagccggggtaacccaagtagcctgaaggaaaccattttaggccacgcaaacgcctctgacacagtcgtaaatttaaaagcacaggtggcatcccggggcttaacaagcggaactcttatctcggccgtgattagtcactctaatcagcgttgcccacgtgtgcttacttgttgagagactgctatatatttgagccacagaatttcgcagaggatttctgctgaccatcaaaaccattacgattgcgatttcgagtagggaaaaaaaggacttgcccacattatgccgattcctaccataagcttcgctcgtgagttccaaactgccaccccgttgtacagctcagaatttttcaactgatattttgcattggccagcaatctttggcaaggacgatgtctcaagagcccgagttgtagctcaggttcgagatgcctgtctaaaatacggtttcttccaacttgtcgaccatggagtcccgcaggacttgtttgatgaaatgatcaagcaaagcgcgagcttcttcagtctcccagaagatgtgaaggagagatatagtaaaggttggtttctgatgtcaaaggagaaatgtgtgtccacttgctcataagatgtctacaatggcagaacaagacaagttccaaaggggatatgaaagacttcgtgcacaaaacttcgagaaaaggacggccggagatttgaaagaaggttactactttggagcggatcttcccttggatcacccaagaattgtcgcggggaaatttaacatgggccctaacaaatatccgaaagaagttacggatcccgtgaagttcaaagagaccatggatacctactatagtaccatgctttctctttcaaagaccattctccaggttttatgcgagacgatggaaatatccaacgaatggatgtcagagtttcttgatatccctatcgccacgcttcgattgctacattacccacctcaagctcctgatgcatcggaatttgaacgaggtacgtatatattcccaggattacgcactgaatctatgactcaactgccgtacataggtatcggacagcacactgacttcggtgctgtgactatacttttacaggatggaataggcggcttgcaagtctgggacagggacgcctcagcctggattgatgctacccctcagagaggagcactggtcatcaacctgggcaatttgatgatgagatggacgaatgaccgctatctgtccaatttgcaccgggttatcaacaagtctggaaagcagcggtacagcgtcccattctttcttgctgggaaccccgacttcctcgtcaagtgctttccgaagtgtgcagatgagattaaaggtccaaaataccctcctgtcacggttcagcggtggatggagggccgttacgcggatacatataacacatcgcaagataaagcccttggagaactctcgcagagcgaagctaaagcgggaatggcctaggtctaggcaatatagacaatattggtggtgtggctctttgaggccgaatttcggtttgaggaaaagagagaaatatcaattcctgcttcttatacctgccactctgacggcgtcctatcttagtgtagttgcacttatttccacagagtctgtaattcctcggccaccagtaacgtgagagaacgtgctccaggcctaactcagtgcaaaccttctctaattcagccattattgagtaggcacttcaacactgctcctgccgatagccgatgttaaaatcattggaacactcagatgttctcatcggaaaccctcttcgtagacacctcggtgacatctttcgcaactaaatccccaccatctgatgccgcgagggcttcaagagatcctgctgatggcttcatgttacgtctttctttccaagtcaatccctctgtgtcaaagatgactgcaatttcttcgagcgtgaatcccttggtttcaacaaagaaataccagacgacaagtagctagtcgaatgcgttagtaggaatactgctgtatggtgaaaatgtcacatgtattgatcttacctcgaggaaagtatagacaatatacgcgatataatacttccatccagcattttgtagaccgatgggattgacgaacgtgccaaagaacccaaaggcgtgcatgactcctgtctgaagagtaacaccacgcgctctgatgtcatatgacaaggtctcggcgggataggcccagagaggtgtccagccgatgtcataggcaccattactgaggaaaatagcaactagaacgccgatggcgtatccagaaccgcctctggtcgtaaagactagagatatgttagctgtgaatacaaagcagatagtcagtatgcagttactacttacgggcagcaaaggttgtccagaggatgaatgcgacaaacattccggctgttgaggcaatgaacagcttccgtctgccgaccttttcaacaaacagagaagcgatagtagcgagaacgaagttgtatatggaaagacaaccgttgatcgtgacttgggttgtcgtgtccgtgataccaatgctgataaggacggcatgcaagtagtactgaacaaggccgttaccagaaatctagtagaagaagagtcagtaagcgaccccaaatggtatcaatgtaaattcacttacttcaatgaaaagaccagcgaaaaagacgataataagacggcgcctattgccagcagtacggaccaagtcgagccaaccagtcttctctttgatggaggcgtcgctttcaatactctctttgatctcacgatattccagctcaacaaaagcattcctttcgtccccgttggcgtggtgctttacaagaatgtctctagcctgcttgccacggcctttggagataagccaacgagggctctcgggcacaaaccagattagcaggagttgcaagatagccggggcagcctggaggaggctagggattctccatgaccatgcattgtcaattttatgagttccatacgtaacccaagcagcgataatagcaccaaggtaccaggaagttgggtagtatgagatgatggcacctcgatgcttaggaagagcaagctcggcaagaagaagcggagcacccaccaccgtgaaggcgagaccaaagccgatcagaaatcgcgagatgacaaattgtgcgagatggtgagatgaagcctggagtatggcaccgacgatagtccagcttgcgccgaaaaagatggaaatgcggcggccgaatttgtccacaactggggtaatcaaaggtagggccagcatagcccccacggtttgaatagaattcaagaggcccagcaccggacctttgggataatcaaattctgatatgatcagttcgcaagcctttagacgggtttcggttgtaattacatacgggattgccaagatggcaggatttggagaccattcatgatcatgccatcgaagccctgataggagctgctcataatgacaatagggagccatagatacagggatctcaggcctttgtcgtgtatccacgacggcaggaaagacttcgacatatcgaatatttctttgatctattgatgggttcggaggcagagaaaagtagtcagttgctgatagttcaatcgagggatatcatggctgtttcgaaggttgggagagtatttaatatttgcatcaatcctatcgactcacttactttgacatgcaaaattcaaggccaagtctctcatcagctcgtatcagatgtcaaagaggcttttagttcagcacgccttctacatggcttcttgcattgttgaactattcacatcgtccatttaaggccagcatccacttcaatctggatacagctagacaataggctactagtcactcctaattgaagactgtatcttagcgcacggagctgagttgtctagaaagcatctgccggagttgtgtggtcgtcgtgcatagaggagtggggctgatgtcaacggaactccacgatcattaagaccgcgatattttgtgtcaacattctcaaggcattatttaggctctgtgaggcaagtatctttaaactagtgatttcgacttatcggagttgcagcttggggtagcccactcggagtttcttataccacttgcatatggcctccgaagatttcaattgcaactccacacaaggtctggctggtaatctccgcaattggattctcgtgtgcttttcatttaacggacggtgtaccagatacaatattattcttccagcgtacccgtggacgacgcctcaaccagctcgtcaatgacaacttcactctcttagatcaaaatattctctctacactttccacatcatgccatctactactcaggagccgtaccctctacccggacacgatagcttgactttggggcacaagatttcgactgaatccaattttgaggctgctgtcatgaacaataagcaagaacgaaaactggatccaaggtgtcacccaagccccgggatataccgagctcgagagcttgtcgaaattaccgcaccattacttgactccattgttcaaggactgggaagtgatggcagtacagagttgtcatctccaaaggttttaatcgatgggttggctgcaagcttagcagtcaccggacgagaatcgacactacctctgtcttatggcagaagtgacacctctaggagagaaatctcagagcaagcccagaagataggagaagctctcgtgagctatgcaagagagtccatccaaagcgacagctccaaacagacacctatcaagctttatagccaatgtgagggtcatttgtggacccaggaagtcgctggtctcttgcttggccctcgaagcaatacacagctgatgcagctttataatgaatggctgcatcgggtcattcttctgcgcgatgctttattgccgtttgaaaacttcgctgaagttcctctggtcatcccgccaacaagcaaacatggtttaatggatttcgaggaaccccgtaaggagttccttctccagtgtttgacaggaaggatctcacaagccgcaatcatcgacgtggcgaaggtcttcacagcaaggaatctagcatctggtgggtacggcattcagtattcccaaggtttgatcttgccagcgtttctgtcctcttcatcgtctatccatctcctccggcatcaccccgcccgtctggacggctctcaagtcgacatattattcgattacgaacaccccgtctattttgatgctgagagaagcgacctacccaaaacaaaccacagcctgccacctggtcactggccacctgcgtcgctcctcgctcttaacccactggtgacaaaatcatcatttggtgtccataaggcaaatgacccatccaggcgagttttgaagcttggaatctcccttgatggtgctcagcccttcgctattgatatcggtcagattgccagaggccacaggtacgcttacagatgcaactccggtgaggagaagaagagggcattccaatcagacgaggcaaaagaaccagattcacaaaagcccacgcggaatggcaccaaaataaatttacttcatatctacgacattgctcagattcttggccttccggggtttgttaccactgacggggaaagccgttcagatgatctgcatcttttcatggcaaaggaccctctaatccagatggcgctccttggaaagctttaccccgagaatgtaatattattgaatgaggatgatgaccctgataaagcgctgaaggttgggaagggatttgggggtcggttagtcgtcatccaaagcaagcggagaaaatgctcagaataggatccgatcatcactcagcggtaggttctgagtagtaatcaaacgaaatgcaaaaatggaagcaaggtcaagatagtgagactctctataaatatcaaagacaggatttctggttcgcatagtttaatcgagataaatctaccaccatccgcgagtattgatcagggtctgtagcatatgagtacccagctatttcgccaagacttagaccctcaagtgctgtcccaactttcatcttctctcttgcggctgctttggcgctcattgatagtttcttggaggtccattcgctggctgtcttggctctccataggtcaatagctgcgggtagaggtgattggaagacaagttcatcgtctagagattcgaataaacgagggtcctgccttccgaccctgcatgataaggagttgatactgttaacaagcagaattgtgcgacgaattgtctctgaaagagcccatgattcccatgtttcttgcggagcacagataattttggtggcctgagttcgggctaagtatcttgtcatctagaaaatatcgtgagcttctgaatacgcctctatgcaaaacagtcaattcggatcacctttagtagccagggctgttgcagctgtgcctgcaagacttgttcggggctttttccaaagaagccaacaatttggtagacacacatagcgtgcacagaggcgagaacccagatatcaggtttcgagcaaatatttggctgccttcgttagcgagattctcggtcacacatcatgaaagttacctcaacatacaaagtctttgatcaaattctcgcgttcttggttgatcatcgaatatgcaaacttttcactgctgcgcattgcggcattatacgagcctaaacagcagaatgcgattgccaatggcgcggtgacctctccttcggagcaacggtagacactcgtatgtacaaaaggtgggtatgttccagccttgagcatcatttgaggaaatccgtagatatattccatccaattctcatcatctcccaagtcttcaaaacgcctgctactgaagactcccgcctcaggatcaagactcggcagccttctgagggcaaggttcggcctacctagctcctcaatatctgtttccactctcaaagatgtgcttatttcttcctcaatatcaggaagttcgtcccaattcaagggggggtaccaggtgaagctctcaaatcgagaatccccggccgcttggctctcttgtggtaaaccgccggttgatggtatcccgaaagattgtagcaaatttattccagaaccgccctgaccttgatttaaacccaggtgcgaaacaaaatatagattctcttcagcagttccgggaatgcctgccggggtccaatgcagattctcggtgggttgaacagcgacatcatttgtgtcaccataaccaaagtcttcaacctggtgagaatctacacttgaatcaagctctgaattgtggattcgaagaacattcaatctaccctgatgctccgcctgatttagagtcaaaattggctgagtcgagttcatggcgtattcgcagtcgatgccttttgatttacagcgagaacaaggtttcagttgatcgcagccagatttagacttaacacatgctccgcaggatttttgctttcctttccgtggcgttgtaacaactcgctcgcaccttcgacgatgtctttcccgaaggtcccctagttcattcttagctcaatccgcatgaagggaaggccatgaggccaagatttacttcgcttaaagcacttgccacataggccgcaatggtactctatgttttcatctgctgtcataatgctgctcatgttgtgtcgcaggagtcatcgagctccctgtctacggttgtatcattaccggaagcctattaatggacatcttagcttcttatagtcaaccgagaccgctttcttcgtgatcgcgtcattgcccatcagtcttgcgtcgttgggccaccaattagccagccaatcatggcttagcttctttaccaaaactgccaaaacaccaatatgggagagccgtttgtgataatggaaactgagtgtatactcatattaagaaaagctcaattcatttgtatcagcaggctattgagactacactgcctaacttaaaaaattgtttgtaggtgcagaccttctcccaggccagacacaatttatgccagtacatcgcaacccagcatcaattctccaatgcttgagatcaggtctgcgcaataagaacaacaatcagaatctctagcacaaaagggccgttgccaaaacaacagggacacagatgggatggcaccgatccgaggaataatgtaaacatccaatctagaagctgcatacgagtgacgcgtcacaactggtagcgataatcaaacttaaagttcgcccaatatcgcctggcaatagagcgcaggcgcccctagatatcataacggaacgtaactcctttgatgaactcaaattggtccgttcttctgtgaagccacactccaaacccagatcgccatggatggctatcttactttcataacgatgaaacatccatggtcacgccatctgcaactttttgccttagactctaatgtcgaagcagctgctcggtatagatacgagatgcttatatcgccactgtgggcttaaacgatgatatttgtcctaatttcgatgcctattcttatgcgtgcatcggttatgtcttgagggtacctaacccgtgaaacgtgaaacgaacaaaacttaaagggcaggcataaacgccaaaggaataaaaaatttaatttttttaaggtttcctttgactgcctcgtactctggaaactttactcaaacccaattacttttgcaaacctcttttccctcacgccaatagcaattttcatccttgtttcttccacattcaccgctgcggctactttattcattcaccattgctactacttcaatcgctattgtcgatagtcaccctcaaacaacagcaataacaacagcaataataacaacaaaaataaggacgttaacatgatgacatccccccgcgtcgggaacaagactaacgagtcggctttttctctccaagaggacatccggcttacaaacgctctggtacaacagctagatgacgcacaagatgactattttcaggacgacgtctcggctttgtgtcgtctactgtccctacgagcagaatgcactactacgtcttcatgccaaaggattagtcaagaaatggaagtcccattcagaaaagttggattcggacaatgtggaattatttacgcgcagtctagtaggggctatgtactcaagctggcaagaaaacacttcgaagattctttgctgggagaccttcgagcacatctccgcgtctaccaagccctggccgactacccgaccgattgtcggattccatcggtctacaaatatatcacggcgtctaattcgccgtggtgggaagcaaattcgcatttctttaaggcccaggatgagcttgagttgccaactatggcactggccactcagcacatcttgcctctgccaaaaagcgttcgaacggcgttaattgatctttactgccccgaagagcacaaggctacggtgacggaaaatccatctaaccaagactgccttgctcgcgtctacctgggccgaagtcgtttacccaacacacccaagtctcccaactttacgctccgaaatttcaatcttcatcttgatcagatgatggagctgaatctccccatcttggatttttctaaggcaattggagaggcactagccgttatccattggtgtgcaaatatcgatacatatgatattgaatttgtgctcggaagcgaagcagaggccatctaccgtccagaaccgaccaccgcgccgcaagttcgaatgaaggcagaggaagtggaatcaatgtcgacacatgcagatgtcgatgagatcgtatccgtcaatttaaaacaacgaccaacgaggctctgggtttttgacttcaacctgtgctcaagatgggatatggcgcaggttctcacatctggcggcgaggataagcttgttgagcacttagttcaggcattctttgaaaatgacccgtactatccaaggccgataagatcgggaacaaatggcacaggcgtggtggaccaggtccgaaatcagctttgggagctgtttagttcagcctacttgaacaaatcaaaagctgtgctggccggttcaactatagagggtgagcagataaagcgccttttagagctcccaaagactttcatcgctcgttgcatcgccggcgctgaatatggccaagaatcaggtaactaatatcatgacaatgaactgtgtattcgtctgtgtactcttattcgttgtgttgagatgtcgggtctggcgtctttcattgctgttttcaactttacacttgaactctcgtacgtcgatgcgctgtggtgtgcgttacggaagagactttagccaactcgaacaattagaaggaaacaattcggggccatatgcgacacggctgccttgacacatgatgactgtgatatggcaggcttcacacgagtcttcgcctagggaacagcaacccgcatccattctggtgcattaattcaaaacacttttatttaaatctcattaatagatgccagcctgactggatctcgctaagatggatgctgcagtaaacaataggtgggaagggccttacccaactcaagaggtaaacatatttgatggaatgaggtcacataactctcacatataccaaattgccaaccaagacaacacgttatctgcttgtagagtcctttacgtagtgcaaaaccgctgctcgcctattcattgagatgcaatgtcttgaaaaagggtcatcggcaaagtcatctcgcatgttcccctcggtggaagcgagaatgactacacgcttgagggcctgtgtttcatgcatgaggacggattcatccaagaaaggccagcgactagctaactagcttcagggggaacatccttatatgagagccgccacctacgtggtgggccaagataaggacttgaagatctccaagagcgtagagaggagccacaatctgttagctcctgatggatgatctcaccctcggggttctcaataacgaagatgcctcacacacggtaaggaccacctatttacggacacggctggtagacgggttgtgggagcaaaaagcttctcacgaagggtattccggacgttgaatgcctggacggtagagtgtatccccacttcacactacaagcacttgaatcccccggcggtaaacacacacactataaacacttgggagctaatgattctcccagggtgaggagatgatagatcatagcagcccctgattcaaggccctccgctatgcagggcactatcgtctcgatagtttgcttggcattgtagattctagattcgctggtcattcctcatggcccatgggccctggagacaatcgcaccagactgattgatgcaggggggcttgagaaggggtccattacacacagataccaattacatggggtgaaactaccttaatcaggaataaacctgcagcattagtagaattaatggatgaagctgtaagatggcaagctgatctgacccgatttgagtttgctagacgtagcgcatgaagaatggttgaaagaaaatgtcagcacgtcgtgccaagtctacctgcatttgctctagtaatgtagggattctcgctttaggccacgcctggtggagcagtcaaaaaggggggaccaagcgagagttctgtatttatgtaggctactgcgagcggtttgctggtctttcaattagcaaacgctccaagatggatccgcgcgcctggtcccaatagcagagtaggcgcgtcgggacgagataggcccgcccagatgccggctcttccatccctcaggagacgataagagtagtgagatgggcggcttggctgaattcgtaaccctggccggagcttgcgtcagctaatggccactggcgtgagatgtcagcgtcctgaagcacttaggggaggtagtatccatccaccgaaaccaatagcgtgaggcctcgcgcttgagactgacgtgggcaaaagaagcaaagaaaaagacaaacggaaagaaaaagaaaacgcccaaaacatcgctgaggtgccaagacgcggttcgagactcgcggtgtgacaactcggcccatgaagcctattcttaccgaagtactccagccaagatatcagacggacctttggttaattaaaactcttagcacaagccctattcgggtccacagggctgggcgtcacacagatctttggttgattctgacgggcagagcaaaattggttccactggctccatcagctgagataacaagcaaatgtaattggtctgtcactaaaatgagcgccccatgtcatcgctcggcgccgagaacccaatgatcgtcaccgttgcgctattgtccaagacacgcctcatgagacacagagatcagccaggagtcgccagaaggatcgagacagttgctcctcagctttcccggccagaccgcctcctttgtctgttggaagcggcggcagagaagcgacaatgcgacagccagaccgacttgaggtatttctactgtccatacatacgtactacgtacgtaccacccgtcacgtagatccacgtctccctcccccaatacgccatctatataccagaaatcccttgttgttgtttcttcaaagtccctatctactgggtaatcacacgtggatcaatacattgacctacccctgcccctgggcacctgtcaggcatttgtagcgcccaagccaatctgagtcagctcaagaggatgcatttcgtctttgagtcgatgccccttttattcgcaaacagaagtcgtaaccggcggcgagctgatataagctactcatcccgagcgtggtctaagatgcgaacaatgatacgatcctgtcgcttgggcgaactggtacgcctctcgcaattcatgagccatgagtgcaagaatttctaattagcggcccgcataggttcggtagtgagacgctccataattacccagttcctgttgtgccccgagcgctcgagacccccctggatcgggatgctggtgtttctttgatacccgctcatttcagggacagacccatgtaccgagctaccgtaaccatatcgagataccaggcagtagaatttgagaatagcgcacgctatcagcagttcctcgctttcctattcgccttcgtaaatagcatcaggacattattgaagatggtgtgtaccagatgtgcccctcatgccgccctcagaccccccagacacacattctgatgctacccaggtagcgagatttggggttagcctaaagtgaactcgtattcataacccgcacccgtagccaaatcactttcctgctttcctctgtcttctgaccctcgttttcttgaatttttatgcgtgctggaagtccctcttttcccctctccaccagcagcaagtgttcatcatggtagtcataaaccagtatgccctcggccgatggggcacagcttggggatttcgtattgctgctgccgcctccatcctagtgttgttctacctggccttgtcctctagcctgtcgaagtaagttgatcattttctcccctcgtcggttcagacaggtgggctgtgagctaatacagttgcactccgacagagacttgcttggcaacgggcattggaccgcaccgtcgcccaacgattccaactctaaacacacggccaaaccagtctcgtcgtcgttagcagagcccaccgaagtaccttcgttggactcgcccgctgctccaacatcgatcgccgtagaggtgccggccagctcgacagcgatcatcgagcagccaaagccgacgttcaccgaaagcacacacgccaacaagaacctcgacctgcctgccctcctggcgcaattgtggaagccaaaatgccacccgcttgagaatcccgtttttatcaccaacgagggcgtccgcttcgaaatcccccccacccagcagatttggaagaaaccgcttgggaacaaggtggtggtcatcgatgtcgacacacgagttagcgaggagaatgagaacacgctgctgaaccccaacccgttcgacttctcgaagcttggcggaagaaccggtggccatttgaatcactatctctatggtgagtggaagcagaagaatgaccatctctggaggaacgtgcaggcaattgctaactaccactaatagcattgatccacggctacgactaccgactcatcaaggccggcgactaccccgatagacacggtacatgggtcaaggtcagcattctcaaggaggctctcaagacgcacgactacgtggtattcctcgacgccgatgccgtcatcacccacctcgagcttcccatcgagtggctcatgaacctctgggactacaaaccccacactctcattgccatggccgaagacctggacatcccgccggactacgacccccagggcaagatcatcctcaacaccggattcctcatcgcgcaggccagcgagcggacgagtcagatgatggacatgtgggagacatgccccgagaagatcgaagggtgcaaccactggaagcacaactgggcgcacgagcagtcggccttctcgtactacatccggtacaacttcaccgagcccgacgaggtgcgcaacataccctgcgcccacgccaacggcaacgagtactacgaggagggcaagggcgcgtgccggggccactttatcagccacaactggcagaccaaggagaagacggtgaccatcctgcagaggagcgtgatgaggatgctagtcgaccggctgcacagccagttcaaggacgagcagcacacgctcttcgtcaacgggtcatctgtcccgtatccgatcgaggaacttcacatttaatgagagcgggcgatgtttttttcttataacgttgactgtagattttaatgattgcatatagacctttttcttttctttatgaaaatattcatgcatacaaagtcaaaccctcaataaaatatataggacatgataaatgaataccaacttcaatcactcccatttgtccgtctgtccttcacaccgcttgctccgagtaggctcgggcaaagagcaattcccccatgaagagcggcatatgcaaggcgacctgagaacaatctcggaggcacctggcattaccctagacgaaacatacagctgccgtctttccaggcaaaatgtttcggaagatagctggttggtttgtggctaattaatgaaacagcaaagagccgatatgtgaggactagtgcatgaatcgatcgcatgcgcttacgtctcacgaatatcaaacaattctgaaacgatgacctttcgattttaatcacggaaaaagatattgcagcacgttaatgcctatatcctaaagggttcttgggtttctctttcttcggctaccggcttgaggcgttgacatgtccaagtccgccatgcctagcctaccctatactctcttgccactcactaccttgagaaatgatcaagtattgtaggggatcattcaagtatacaggttgacctagcttttggctaaatcgtggatggtatttagcatatcgtagacagaagacgatcgagttttttgcaatttggttcgtatggacaggcttaaataacagttccaaggctctccttaaaaacatctccgatgctatccattattatgtattagcaccagagcatttgtagaaactatgaatgaattctctgtcatcaaattagagttaacaattggactttatctcacgtggcagatagattaatcagaccctggcggcagccttgtcactgacgaaactctccgtacgacccctgaaactatcaatagcaactaaatgaacttctcagtatccgagtccatggaacctgaaggtcgaccgcacagagggatataatcctgcattttccgaggttacatgcggagaacgataggcggtcatgtgtccccgcaaaccggcggtgatggtggtggggatgatcagcttctgaattgcactgtgaacaggcatactcccttgactccccacattgacaagggcgatgaactcatttactggatgtaacacgagggaatgatgcggggatattgagtcggtcccttggctgtgggcggatcaggtccgactacggcgaggtttggcattgtttaaaatgcggttgcgctcctagggaaatgtaagcgacaggattagtctaccacaactgctcgtcatccccagcctcatatgtctaataccatggaggcgggccaaacgaaagaagcgctggagtccatccacctcgaggatcaaagccaaacgccaacttcgaaaccgcacactgaggatgtagtgtccgaggaggaacgccaaaggatccttcgaaaaatcgacctccgagtagtcccaatcttggccgtcctatatctgctcagctttttagaccgaggtaatcaattttgcgtttttgcgtcaaacagggtgctgaccatgagcagggagcatcggaaatgcaaatgttttgggactgtctgcggatctgggcttggttggcaaccaatataactggtattatctccgattcgctgttttcaagagacgttagtgaatgcatgaggcttatcatcaaatctagggctttgacgattttcttcttcccatacagtttctttgagccgttttgcaacctactgctcgtcaaatttagtcccagccgctggttaccttccataatggtgctttggggtagggaatctcatctcttcaaactagagaataatgagctcatgcaacctaggaatcgccaccaccctgaccggcattgtccacaactactcagggttgctggccgcaagattcttcctcggtatgactgaagctgggctttgtaagcgctatgaccctcggagatgtcgcgaagacagaacctaatcgatgaaaatagtccctggaattgcattctatatgtctttatggtatataatacgcttgcgcgacatgttatcagttttgagactaatgcgagtacaggtatccgagagaaaacgcacagtttaggcttgcgatggtcttcgcatccgcgtctatggcaggtgcattctccggtcttctagcctaccttattgacaagatggatggggatggtgggctggaaggatggcgatggatgtatgatttcccgatcttcattgtccacaatcgttcttcctgctaacttggatacagctttatcctggaaggaatactgactgttgtggttgctgcctttgcgtactttttggtcatggatgaacccgctaccgcaaagtttttgacagaccgcgagaagctggtgttgcggaagcttttgaatgagggcagcgttgaaagcaacccggagtctgcaaataatcctaccttgggacaaaagggagagaagaaatcgtcgcatgcatggaaagcattcacagattggcaggtcagtgcattgctatcgggatactgggacgcaaactaacagattcaaagactattttccatgctatcaattattggggaatggtgagttacaagctcatcttcctgtcgagtcacccatgctgattatgaacaggctactgctgtatatgcattgtccttatttctccctaccatcatcaatgggctcggctacactgcccagattgcacaactgttgaccatcccagtgtatgctgcagccacagtattcacacttgcggttggctattacgcagacaaaaccgggaaaagaggcatctttgcaatgggatgctatatcgccgtatttgttgggttcctcattgcagttgccccgtccaactttgtccctggcttgagctacgctggatgtttcatcgcagcatgtgggatgtaccccagtgagcaactcccgtacgaaatagattgtttgatattgcgtatctaatattaattctataggcattccttgtctgctggcccttgcatcaaacaactacgctcctcacaccaaacgcgccgttggaatggcgattcaaatcggattcggtaccatgggaggcgctgccgcagctaacttttataagaaaacggatgcacctcgatatagactgggacactccttggtattgaccttcgcatctttaggtctcctcacggttgtgggatactatcttctgtgccggaagattaacaagaagagagacgctctaggtcccgagtcaaggatagctaccgaaaaagagctgctcgagttgggtgataaggcgccgagttttaggtacaagctttgagagaatagagggaactagagtgtagagatgagacaagaatggttatatccatcgcgacttaccgctacatcgcgagaaaagaacgtggatgtgcaatattttgttggcctagatagttgaaacagacaattgcacagggaggaagaggagtgaacttgagaaaggcaagtagaaaattcaattattgatcatagatgattttttttatttgagccggtatcctgtttgaaaaggatctgaaggatcaagaactatttgtttgtagcttgttatccagcctctaccttgaatagttgggaggaccgcatctttgtccccaaccttggtcaagccgcggatatgacagataaatcttgtcccaattatgctttgaaacttgatcatttctccaaccttgagcaaacctttcgcatgtagaacggccatccttgcagaactgccggtaccgcatgggcttctgtcgagtcgacctgggttaatgaccatggcctgcctggcgatcttttcaccactaatctcttgtatgggctctgtgatgccgatgttatcgataccacgaaactctggcgattctggatgaataggagtgtgcttttccaggactgcggctttgatgcggttgcccaattcgatgagttgtggcccgtgttcgttcaagaccttcaggcccaggctcgccacgtcaacgaatacataccaccgcgctccgaaggcgatgtcaaccgtgactgtcccaacaccaggtaattcaatcggtaagtctaagccgtacacaaaagctggcacattgtcgagcgatactgatttacactccccctgttcacaatgggcttccaccttcaccaagcccgcagcagtgtcgtaaagcacctcggtcagcggttctttgatgggtatcatgccggtctcaagcatgacggttgtggtgcagatggcgttggatccagacatgggcgaccaatctccgctggccatgacgacgaatcctgcgtctgcccgagggtcgcatgggggcagaatcaagacggcactcatctccaggcggcctcttggttcgctcaacagtaactggcgtagatcttcgtggtgctccctgaagtgcaagaacttctccttcatggtcttagctggtacatcacgtacccctccgacaatcacatcgccaacctctccctcggcatgacatccaaccactgaaatgtaccgtgaagatttcatgatagagctgagctattgtctacccatgaaaagcgagaaaagtgaacagggtggaattcagcctgccggctgaaaatgtccaagacgatatgagtgccgcgggcccaggggtttaattgcgcaatggttcactcgcttgggctcgcctggatgaagctaggtcccacgaggtcggatggaagtggctcaggactgggatgttagcctattccgtgccacttatctggcagactggttgactgggcccgaaaccggggatcaactccaacagccttccgatgagggctccgtgtgcgccgacagccaccggatgccacgtgccatgtcgagactaacatgactccgatcgcctttgagccactcatctggaggcttcacttgcctatctcttttccgataccctgccttgctgctctggcaatcattttgtgcttttcggcatcaattgtccgacggtggagtggggttttcttatcacgaatggaccttgtgtgtggggggagcggcactcggccttgggtatatcactatcatgctcatactttagttatacggatggatcagtccatgaatgaccaggtatgctagttccttgcctgaatagcaccagtcaacctagtaaattttctcaaaaaaactggacaatctcttggtaggtacgtgtataaataaaagagtgacgccatctaccacgaggaggtacgattatgttacagccacaagacgcaaccgagcaccacgcagggaaacacaccatcttatcttcagcagaacgagttatcagatctacgccatctgcagtagcttctcttggcaatgggcaagtcgtcaaccaacaccaccggtatcattggtgcggcagacaacaaggacaatggcatcatcaacgaaattggcctgaagggagaagaacttgaagccgagacactggactccaaaatcaaccgcagactaagacttcgagtcgacttcattgttcttcctctcatgacaatggcgtcagtcattgcgttgcttgacaaggtaagccaagtctttgatacaatgaggggataaactctcgctaacttttccctccacagaacgcgctcagttttgcagccctgttcggaatgaaagacgacacgcatctccacgggcagcagtacagctggttaggctcgattgtgtattttggatacatgattgcgcaattcccgctagggtggatcctagtgaaggtgcccctggccaagctcatgtcgttcctcgtcctgacatggggcgtcctggtgtgctccataatggcgtgcaacagctttgcgggccttgctgctattcgctttcttctgggcttcttcgaggcgggcatcgtgcctatcaacatgatactgacgggaacgtggtaccgccgtgaggagcagcccctgcgcaccgccatctggtacaacaccctggctggtgtcttgggtggtatttttgcctttgctatctccaagcttgatagccagtatcctgtttggaagctcatctttctcatctatggctctgtgagtcttggattgggtgttgcaatctttttcttactcccggatcatccatctcttgcttggttttacaatgtcgaagacaagaaaaataaagtgatcaggattgcaccaaatcagacaggacaaggcaatgttcatcaattcaagtggggtcagattgttgaatcactgatcgatcccaagttttgggtgttggcgctttacgttattgcttggggcattgtcaatgccggcattaccaacgtaagttctgtccgacctcagctccgagatacgataaattgacatttgcgtctagttcaaccctttgattatatccggctttggctattccagggagagaacagctttgctggcatcgccacaggcggcagtggctaccttctttgcgatcgcctgctccgctgttgcaaaccatgtgccaaatatccgatgtttaatatgggctctctcaactcttcccgggcttgtgggcgccgtgctcattcgcggtaagtgttcagtcattaagctcagtcagttttgtagcgctaatggcattgtcggccagttctcgatcctgccacaaatcgtggtggtgctctcgcaggcgtttacatgatgggattctataacgtctcatgggtcatggcaatgtcccttgtttcctcgaacaatgcgggtgctactaagagatcgtttgccaccacctccatgtcactcctttacgcgattggcaacattattggcccacagctgtttcttgagactcaggctccccactatcccctagggatatatgccatgatgactgcatttgctgtgcaaggagtttgcggtgcggtatactttgctctatgctttattgagaacaagaggagggaccgtgaatatggcaaggttgaacatcagactattgctggtctggaagcagctgagaatgacttgacggacggggaaaacactgccttccggtattgtttgtagatggcattttggagaggggacctgtcatttggactgccagtttgcaaggattggatgttctccccctggtagctttagttgggtcttggaatttaacttcaagattcttaggtgtttgaatctcacctcatatgattcatatttccctgggcactttggcagatgaagaagctcgacacctttgacttcggaagatttttcatagatcggcacgccaaccacggttgcattccaaaataatctctaaccttgtgtcacctgcttcatggcagagctagttgagtaagggatgtctaggttcctattctggcaagatctttttttttatacgcctaaggactctcccaatcccattgcacaaaggtaccaaactcaagggaagctggacaaggagcgcgaaagactgtcattttcgcgctatctgtcagacaatattggattatagacgtggatttgcagatggtaggcgtgattgggaatttcattgatcagctttccacgttagtgtgtgagtggctggctgagtgcgcagtagactgcagtagcgggccgttagaaacgttgcgggtagctgagggccaggatgggtgacgaatggcatataaatactctctgcccctctttcccaacccgagctgaatatgcaggtcgatgacatcttcaagaaggattgggccacgacaagcggcgattggccgttgcaacacatatctcccctgtgaggtcctaactcgcttaagagctcggcatcgccatgcgcgaaatcagctggccagtgaggtggcaagtgtgttcgattttgtcttacaaggagaggaactagacaaaatattaccatggcggagaagaaagctggtgagacgtggcttagagctcgaaagaggccctcaaaaagcggattttgtaatcaggggtgaagacgataagtacctagacgagaaaactaaggtacttataccttcgtgtagcaaagctacttgtatgtccttttcataatagtatatttgactaggttgatattaactttcactcaagaagacttaagttgatcggggcagcatcatcgcaatatgaagggtccaggcctcgcaagcgccaacgcggcgaacaacaccccggattcgttgggttcatcgaaagtaacacaatttctccgtacccgggactgtgatattcaagatgcgtttcatcattcccggtcgcagtggattgatgacccagtcatctgccagtggcgagatcccacacatcatattcaccgtgtcctttcggatacaaacgatctttatcacgaatggaaactgatgaaaagaaggctgttctccatttctacatgccctatttggaaagacactggccgcgcccttgcaaaagtcggcctgccatggcacagcaaccaagtcaatatgccggatcaaattgactccagctggccgttccatttcaaggattttgagactcagcttctccaactactaggctcccgggttggcaactcatcagctgttggatacgtttctagtcacttggaggcaagctgctattgcatccgtgcattacagcaggagctgaggagaatatgcccaaaccagagaccagttctcgtttatgaccaatttgatcacaagctgatcgatgctattcaaaggattcttgggcttgacactgtccgggttcatttatccgatccacgggaggaaatgatacagaggctactcaacgccactgccaacagagcccgccctatgatatttgttgcatcagtagggaactctgccaccgaaaatgacaacattagcatcattgcggacatttccactgaatttcctttgatcctacatgtcgacgcctttcgaagttttgattacattacgacgatgtcggaacatgaaagacgacgagccggagtggagaaatttgtcttggccaacaaatcttccaacgacttcccaagaaccgaagacggctttgtcattgcaaatagcatagtagcaggcggcttgaatcaaccccatcatggccctgcagtctcattaacgcccaactaccaaggcgtcaaaggggagaaagtggcgtatatcaggtcatttgatacgacattgggtggctcaagggacgcaatagcaccgctctggcttgctctatatgagctaagactagggaatagtggcatccaaaggctatgcagggacctcctgaacattagatccagcgtcttgagggttcttaaatctcagggtatgacggcatattcatcaacctactctttagatgtggtcgtcatttccttctcttcatctcagaagcagcgtcttttgaagttaggcggaactctcgtcaattctggagaaatcgtgttggccattcagacacaatttctcacaggcgaggttttcacttctagcccttcattttcggaatcactccccaacaaccttcaaactttgttgaatcagtacccgattgatccatcaattctgcaaaaactcaaaacaactgtgcaaggttggaagaccattaccaggtccactgctggctacccactacacatggggtctcttgccgctctggggccagttattgcccgtttttgggatcttgacattccacagcattgggtagaaaacatggcacacaacattctgacctcccgtctagcatcttttggggttcctgacgtagggaatcagtgtactttcaaggcagcttttaccaacggcagtacaatgggcaaccggtgtggaattcatacagctttctcccagtttcccgatgctactatttacctatcgactgagacgcactacagtgtcatgaagacacttcgagactgtgataagatttccaatgtctggtcattgaaagaaccccagttttcccaaattccttcggattctcagggcaggatgtgcgcagatgcgctcttgaaacaaatcgtgttggataagcagcgttatacagcagaaggccgggaataccatttgatcctctttgtaaacattggaaccacatttgctggagcgcgagatgacctgtctgaaatctaccaggcgctaaaggggcatggcatagagatttcgtacattcacgccgacggagcctttgattttgggtttgatacctgcggcatcagactgggcaagcctggatctgttgatgataatggcatgccttgtgtacagggcgttacaatcagtctccataaggcccttggtcaaaatgtatctggagaggtactttgcttcacccccgagcgcgatattgcagggacggtcccaaatcttgatgctagggtcgtctttgaaacctggctgtataatcaagtttacacgcccagagatcgtcttcagctgcgcaattactgcaagcaaaacgcatcgtttttggaaaagggacttaggaatttgggattggccaccaagagaaaccccgacagcatgattgtagtttttgaacggccagtcgcttggatcacagaagaattctctctccggccggagggggattgggtccatttcatcacgatgcctcatatctcaccagaaacaatcgacctcttcctggagcggattaagaatgtggacgaggcgtgccgtgttgcatttagtagcattgctccactactaactgatttgctgggacgagggatacaacttaggcggttacaaaaccaatctaagtcgcctgaaacactccgtcggctgtctaagcttctcaaaccggtgcaatctggatatcatgcagagttggaggagcttataaagcggagtgtccgtggtgccctttccgttgctgctgtagatgacgaggggaattttcaacttgtctttcttgtcgagtccaacagaactcagtcaatagtggtaaatccactgttgctacgtgctagctttatgaacaaacttcaagccattcaagatatacaagatcagcttatgggcctcatggggaggtatctgaaagctaaaattaggccgagcggcgtcggccatcaagtttacgtttattaatagattagagtagtcaaaataatctttctttgcttaagtgaacagtttattgcctatttctcagctctccttcgcacacatgcacaaatggatggcagatcatcacgctgctattaccgaagcagcgagtcttgtacaagaaactcactactaaggtttacacctcactcgcatagttcgtaatatttattcattggtactcaatgtctcgcgtaaaaagaagttcccaacactaaagcctgttgtatgccttattttcgtccggcatgtgccaggctacggggcaacgacagagttcagcggagttgcggagaagcgtacggagggttggccggaagcttgagtcgcgctagggacattcttatgtgggctcaagcctctgttgatgctagacgttgtctttagtttaagggcatgggccagtctccattaaaaccgccacgattggcaggctgttgagtgcgatgtaaagcagggaagcaaggagtagtgaggataaaagtgattagctacgcagttgacctccatattcgtttgacgcgcctccggttgctcttcttgctcttccggccgcccctccggtcccacttcacttgggaaatggcggacccatacagagtgaaccaagtataaaaggtacgacggcatgctgatggtggccaacacagatgcacaacccatcttctcagcaatctacctataccattagtctacgaaagaaatgagtgccgaaaattccaaagcgaaacttggttccgtcgagcctttcacggtcgacttgtctaagaatgtcccacgaatgctggatctggtgaagaacaccaagttgcccgaaacatctatatactcgggccttggatcatcagcaggaattgacctgaatgttctgaagcagttacaaaagcagtgggccacggatttcgactggaaatcggaggaggcacagatgaataggtatgcacctaatgtgaagcactctctaagcagtcacggcatttctcacccagtcaaaatggtagttataatcacttcaccacaaatatcgaagggttaagaattcatttcattcatcatcgttctgaaacagctgggtcaataccccttctactcctacacggctggccaggctcctttttggaagtgttacctctggtgaagcctctggtagagcaggcgaaaacctccaatggcactgatgtctcgtttgacatcattgtcccttcgctgcctgggtttgctttctcacaagcaccaccgcctacttggagcattgccgacacagctcgaattttccacactctcatgactgatatacttggctacacgactttcgctgtgaacgggaccgactgggggtctggtatcgcttataccttgtatgagcagtatccggccaccatccgtgctgctcatttttctatgatccctttcatgccgaaacttccaaatcagctcgcagcggataatatcaccttgacggagagtgaacagtttcaggcggacagatttgcgaaattcgctgcgacgggcactggctactttgttacccacaccactaaggtaataagcgctgctgaacattcagcaaatcataacaatactttgtgcatctaactgacaaaacagcctaccacgattgggctggcattgcaggataatccgatgggccagttggcttggattgctcagcaaatccttgactgtgagtttacctggccataacaagcacatctatatggaagattctaatacctctacagggtcggatccacgggcaggaactggcccttccgtactgacacatagggaaatacttcggtttacatctctctactttcttaccgagtcgttcctgtcatctatttttatttattcttcgaacccgaatggctttagaccagagtattctaaggcttccacggacgcgcccttgttgtatagcaacttcaagtacaacaacacattctttccgccagcgatggtgagagaggttgggaatctggtatactggaaaggtacgtcgctcggcaataagaccccgtgccaattatgcaccctgtcacaccgataaaatatcccaggaggaatggcattatggtaacaaatgctattcgttgtgttgagatgtcgggtctggcatcttctatagttgcttttaacttgacactcgaactatctcctgtaacagttgctaacactattacaatcttagatcacgagtttggtggccattttccaggagtagataacccaccaggcctaatctctgacatcagagagcttggaaatcattggcgatggtcataggtcctcccggttgtgctggggggacggacttttcttactctgagatgtagatgaagcgaaacgcgtggcttcagagtttgttagatagctatggggggtagctctagagggcgtggtagaatactcaaggaagaccatattttccactttcaaacctagaccttatgaaggaaggagcatgaatgaccttaatagtctatactggatgaataatggagatttgcgttaaagcgataattcccgcgacgagatatctcccacctctttgcccccccccctcctccccgcccccttctaacgtttgatgaccggttgtgaaaggtcgtattgtataaggagccttttccttctgtcgccgaactaagtgacattgacaaaccctacatgtcgagcatacagaaagtatttgatttaaaaagccgtcttgctatgtagatgggagctgctaggtcagcgggaaggggagcagaggggcacaggagggggcagcatcgagcgccacaagccctgcatcctatgagtattgtgtttctagacaataaccagttccgaggccaactatgcttcagcttactcctcccgccccccctcccttcacacactgctgctacacccattttgttcatctcatcgcacgataatcataacctgaaatccacgaatagggtccgccctatgagcctcgcgttgtgggtttgaatgttcaaatgccgttcccaatgcctggtttgttaataatctctcctccactcgatatcaatttctgacattatccagggcacccgatggaggagcaacactctgcgctctccattcccacccgtaagggaatgcaccacccgatttgggttggcgaactccctgttgtcgcccagctgagaaacgacaaagaggaattcttcgctgttttcaagccattcgatcttttgtactgcatgaaatgcaaagaagccatcgccactagcgagaaagctatttctttgcaccttcaagggccctgttacaacctaagtgccggaagacacgtcgagagtctcgctgtgaaatatcgatctctcttaaacacagaggaggacataaattggttcgtgaggcggggcaaactatacgagagagtacagcaaagcaacataatacttgaggagataccatggctcagtccgccaatccatggtttccgctgcactctgtgtggccggccattgaggaaacggaacacctttcggcaccacctgaagaacgaccacgatggggtaaaaagcgtgccagaaaagtgcctcgtacaatcgttcaagagtatggggcaccaatttatcaattttcgagttgtgcggcgtgctgtgacaaggcggttgggccaggcaaagagccagaacactcctacacggttataggacattagaccggggcaggatgtcagcggaggctctcacggatcttttaagcttcttttgctgtctatcacactggaaataataggagaaccagattctatcttcctttgatttgcagactattcgattaaaatgaaatacctgccttccagaagaatcatgttcttcgttgtctagtttaacattacgagattgttggcggtgccagtgcaaataggcacaaagactacagcagactaaacgtgacgggaaaaaggctctcgatcctccaatgcgctgtactgtctccatattaattaatatttttagtatagattcatcatcgtgtttttacgaatccggagctttcttagattacacggctcgtggattgatgtgaacataactcactatctgcctaacaggccctgaggagggcaatatctaggtgggattcagccactgcggtctatcaaactatttaagttgactgcgctgaatccacaaatggttgacatgtgtatgatccttgatatccacatcttttgatagtctcaacgtacagacatgatttggctgcagcaactggcttaatacttaagcctcgaaggcacaaaatcgcccttttcgttgtccacgtgcatcaacttgagtcacaggcaatcatggggcccatcgtgaacctaccaaccctgggcgacgcgacgatgatgttccaaccgacagagacacaaggaacgtatagaagcccaagtcctagccccagagaaatgtttatatgcagcaataccttgggcgacgaatgggatcaaggtgagacaaaggatgcggatccggataagcttggtttcgtgctggcaatgcgactagtcggagttgaatagggcaaagaggcgttcgcaaccttgaaggattgtaacttagaatacatgtattctattgatattgttgagggggaaagtaaaggtggaatcaaagggggaattgaaggtggatatgatggtgctatcgcaacgaggacggttcacttcgaagggaaaactctcccaagatctccggcagcggagcgagttacggaataaggccgtatttgccctaaactgtatgaatcacacggtgccaaccattggtctgaataaaaatctcaccatttcattctgtcaatgaatgtactttgtcgatttccggacttcatgccattcgaaaatggagagaacccattaccaaatccaatttccgacaggttgttctttcgtctacctcgggttttcggcctatttcagaagccatgcttatctctttgccagagatgtagcgtatgcgaacaattaaatgagattgatgatgttgttggtgaagagctgctccacgatttcagctcacaacccatcgtatacaagactggagataataagtcaaatttccagcatcatatcatatcgaatggagctcttcataactcggctcgaccacgctagtgacacagtcgttgcttctccagatggtaaagcttgtacaagtattctggattcacacaaaagagtgcctagacgccacctatgggaagagctatgctctatgctgagcagtagaaacgctcctacatttttgataaggtcgaagaacggaaccaccggaacccatagcggtgaaaaggtttcgacaaacgagacgggcgaatgtcagagctccgtgacctctggcacatcctactcccaagaaggttggactaccttggggaagagatcactaggccaggatgatgacggcgagtctcacagtgggaaacggccacgaaacggccccgccataaggaacaagaacgcgagggacatgcgatgaggggaggcaaactgatatgggcaataactaaaccacagaactgaatacatttgcgtcatcattttcagctgggcatatataatctgtgacaaaacgccaaggacattgatgtttggtcgaaatgatcttgtcacttggcatcggtctataggatagagaaaccaaagctatcatgactttgtaattaacaatatctagtacagatcaacattcgtacccagaaccggctctcggataattcagtaattgtcaagagctcgcgactagacgttgtgaaattactgaaaagaagaagttggtcgaagtcccaaaccgctcttctcatatgccatatcgaccatcctcatttgatggatagaatcatcggcagagatccaaaactgtgtccctcggcctctgattcggttcaaaaactgctcaagctggtggcggtacgacatccaccaatcttcgcccggaagtttggcaaactcccctccagcctctttgaaggtgtatgccttgtaagacttagactcactccacttcttgatatggctgccatccgccttgttgcgaatagcataggcatcttttacatcaatgcgatgccaaacaacagcatgcatgaagccgtgcattgtcacatgccgagtgcgcaccttttcctgggttttcggaagagaaggatcgtcgactacaacccctttgtgcgtgactcgaacctccgatggcttccaaagtagtggccccctcagcgttccatatgactcggcgatacctccgtttggaaaacggaatgtcgccttggcagcatagtcacacttgtcatgttcgccatcgtcaaagacattgtaatcaacgcttaggcattcttcaggctcagcgtcgtatatggcacggatcatggcaaacgaataagtgcccatatgcatcatactgccgccacccatacggtagttgaacccaatgtcccccttgctcgtgtaagcccagggcaccattccatccgcataaacgtggaccacatctgctggtgtgacaaagctgtgaagaagttgaacagcaggatgaaagcggttatgaaatgcctcgagaatgacaggggcattgggctgcgacagttccggcatgttgaagagcctggcggcttccgcttcattattgaccgatggcttctcaagtagtacgtgcttgcccgcgcgaatggaccgcatggcccactccatgtgtagagtgttgggaagcgggatgaagatggcatcaatgtttggatcgtcgaggatctcctgatacgagtccatcacttggggtataccatgcttctttgcgaactcttcggcccgagtgcggtctctagcagagattgcttgtacaataacctcgggatgagattttgcgggcacaataagcgacatggggctgttttggcgtcaaaattctgtccatgaactaatgttttcggcaagttggctttgggacttacgctgtcctggcagctcccaggattccgatctttatggcatcgcttctcttctccgcagacggcggatcgaaagctgtaaagattcttttgagaagtgtggccattctatcgaacttttcaagaagggtaatatatatgtgatagcgctgacaagagtcttagtgagtggtgacggtatctcacgtgaaaatatgattcgagttatgatgaaattagctcgtattgtatattgaaagattgagggaagcatggacacttatatctgcttcagatggaacaatctaacgggaagaaacactgcctctggctgcttacttacactcgagatccaatccctaccccggctcatcaaggctatccgatcagtattagcgcgtaacgcatccaccagccaatgcgtaaaccagattggctatttcctggcgcaaattcgcctaaattgggtcatgattcggtccattcggacacggcacatccaggcggagacttgtcagcctcccttcttcccaactaccaagagcagaggtttctacgacgtgccaattcgtcgctctcctgcccccgcccatattgagttacccattgatgagactcagcgatttctaagcaaggcatggcgagactgattgctccgaagcccggtaggtcctggcgctcgctatgccacgtgatatttgcggagttttggctaacctccaccggctagatttcttggtaaaacacgatgagaccaaacaaaagtttgaagaccctgttgatagacggaagcgactgagtcgcctacgacagagggcatggcgttagacaatttcccctactgatgtaaatgaaatatcctaatatagcaactaacccggggaggtaggcgacagaaagagagctgcctgtacaccaccttccaataccaactctggatggaaaggctatgggatcttagtttccactggcactcaagagaacattgaagcaacacatgaagcagaagttgctcatgcaaagccaaataacagcatactaattccaccactcatcccctattccacattgtttccagcttataaggttgtcttccccctctctccggatcatcgcctcatcacaattgtccagtacaatgtcctccgagcaatgatatggaacttggcggcactatccatgttggatcagattccaagtgattgcgccgaaacattcggcgtttccggccagaatatcagcaacaataccggacagattccgccaaaccttcaatggacatcgatacaaagatccatggatcatccctactggatcagtgtcattccgttccctgctatgagggataatttgattctcatggcagaccaatacgatagccgtggtctcctgcacgatgtgggactagggttatacgaaggccttgatgatgccgaaagaagaggcttcttggtttgggaagatccatggcgtgcatctgggtgggaggttagtgagggttttgtcaagaaatggggcttcttgctcaaaggttgttcagttgagatggagacaaccaatcggtggagggagttgcgaggggaggaaaggttggtcattgaggtatgaaagtgaaacagggaagttcaccaggtagaacctcaacatcaagtaaataatagaaaatgagctagaagtctataatggttgatagtattgctcagttcaatatgtgataatttaaaacctaaaacacatggctcagtaaatctgacttaaatctttgatcatctttctaatgacccttccaatggcgaaactatataacatcctatctgcatctacggcgatgtagttgaaggagagctcaggttatcgatgatcttctctacaccagcgaaggataattcatccattgtctccttccacaccctcttggccagctgttctccctctgaagtatacacaaggacgggaagactaaaacgaatgtgaaagatcagtatgttaatcaaacacctaggattggagtttactcacggcctcagcttgccattctccacgaactgtccgtgcgactcagggccagccctcactgcagcagccaggacttgactagcgcccaccgtacaagaatgaccgaccaggcgatagaacattccaattatgaacccaaccacccctgaggtttggcgcaggaagagtgagccgtgacaaacacctggagtcggcgcgttgatgattaccgtctcaggcgagatccggtgggttaattctccaagaaaaagtaaggcaagaagcttgctggtgctatatcgctcctccatatcccagttactggcacttttgtcgccaaaagcggcgagtaatgggtcggagtcgcgctcggcgaactttgcccagtgagccatgattgaagacacgatggatatccgtggtaccggagatggagtaaatttggctgctgagggtttatccttgacaataggtaggaggagagaaagaaggagtacagtggacaggaaattagtttgtacgtcttcatcgtagccagtggacttattgaaagtcggtttggcacagagaacaccggcgttgagcagaatcacgtcagggcgagcctctagcgattgtgcgcgttctgcgaatgccataacggaatcgtagttggaaagatcaagcttccacacttcaactttttgattttcgcctcgtcctgccaataaggccttggctgcagtccggccactctcttcattgcggactgcaaggatgagtttgcttaggcctgcatccaatagctgacggcccgcctcaaatccaacaccgacattaccaccggttatgattgcggtttgaccactgagatccgcctctttctgcgtaagaactgggctcttggtctcgaaaacctggcttttgaaaaagtgaaactggccagcctgttgttttggagtggtatcgaacttgggcgccatatcgagggtttatggcatgagctaaatcggaaatattgcagaatgagatatacagtgttattcagtagaacagaaccagtgatcaaggtgccctgcgtcatctagtatcaccttagggcatcttatgccttttatacatgcggacgggtctcacagctatctaaatctgcattttaggcggatttattatttataatcaagcttctgtcttcatcgtaatggcacatgctgcgggctttgaatctacgatggttgagcttaggctatccttattggttcgctaagagtaagctgagtcttaatgaggaaattaacggtgacagaccaagcttgatctccgcactgactcagcttccatcggagggatgctgggtaaggtgagtttcctacccatactaacgaaatgcgaagaggtcgctaccccccagatgatcggttccactccgactcgctcgaggttggcctggtatatgaagcaccaagaactgtatgtatcaaaccgtgacttgacaccacgacgatgcattcgtcgctgtggaataatatttgtgccatcgtcattcaaatcatgcttgtctgggaggtccttgaggctcaaagatattttgtaccaatgatcagtgcgacctcatgcgaatatgccaattgattgaaactcaacaaaggctctgctatagttaaggatttggacatattcgaggataacaagagacatactcatgtaatactagtgagctattatccctcccattacgatcattacaggcggttattctgttacctttatagccactcagcatagggtaccttaagctctagtcaccgaggaggaatcaaaaaccatcaaaagagtgcttgtcaaaaagcagggcatcaggtcaacacccccatatcatagttaaaatatagatacaatttagtgcaatccaaacttttatgtgagtacgcactgagctaatttgaaactactccatctctgtattataaaatgaggatttgatagctataatctactcctcgatattaggacttggctccttatgttcatacatccaaccaaccacgggctgaaccgaatccaacccagcgagaggttgaggcccgatcctgtatgaaccagattaatccgagagatctccgctggtgataatgcggtttccaatagatccagcaagtattttgacgctctgcatctccccattgctgttcatctgttttggtatagaagcagagcccctggggatactctttgtattgatcatccggggtccacctgtggaatgatcccggatttccagtccctcctcagaccaaaaacaaaacttcgacaaccagccggataaatagcgggttccagagcgaccatcgctgtagtggacgatgttgttccaaaattcaataatattggaactagttggatcatcgaaagaattgacgaaatggtccaggacggtctcgagctggtccgcaaacttttcgacttcctctcggtgcgaggttgagatctcccataggcgatcgcggagtctctcccagtcctctctgtctcccagaagggtaacagaaggaagaccacaaccatatgagacggcgtagttgaagtacggctgccgagtatccatcataaggtagcgtgcttctactttgtagggcatgatcgaatttcttggatctgagtcaacatctccaatctccctcgctattgatagagctattgccttgtcgtcatccccagtagtagtaaagtttggcctgatccaatttcttagatatacttcgttgtcccgatttgcccaagattcccaatattgtagatctccgtcatcagcatcgtttttagattccctcgtttttgttggagttggccctcccaactcagcttcttcaagggcggcctcagcttcttccatggtggcataatccgtggccccgacatctcgccatccttcatgcgctgtcaacatgtatcgaaacttgtcgccatttctgtcgaagtagaagctaagctgaaccaaaattgataaccagacgtcgtcaggccggatccccaggtggtaatgtccattgtacgcttcgcaaaccgcatggacaaatccattacaataagggccaacgtattcagtttcaaggtctttgaatggcgagtctagtaccctcgtacattgctccgcttcctcgggacataattccttcaacaatccttcgacagtcttggccgaagaactatgttcccaaagtctggggccgttattcgtaaggcaaacagtgacaggcatttcgtagtttctttctttagtgaaagggtggaagaacttgctgatgatttgaggtgaaagggaggggtgggattagatttgagtagcgaacgtgctggcgggctatatagagggaaatatgtaagagcaagaaaataaagttcaacagcaatgaaagttgccatggcccgacaactcaactcaatgaataatatagagggggatagattgtagattgtggaccattcaccaggcaatgacacgtaacaaacgtaaagctttttagctcattgtgtaataagaaaagaacaatgctgcagtatgccgctgtcattaaaagttacctcaacaacaaagacgagtcgaagtttaactcttgaaagtatgggagtggacatttgggctttttcagctaaattaacgagaaattttaaatgaatccattgtttcgagaggtcagtgtgttcagataggctaccaaacagcgaaaaacaccaaatgctagtacgggtgaagtgaaggctttggcttagagcactgcctcgtattcctatgcattgttatcttaaatcccccccccctaatggacactagggttctgagatcagtgattacagacaaaagcttttatgcaggaatgtttgaacttccaagaaggtttgatcctcgatttttggtagaactagcgcgaacgtccttgcttgcttcgctattatgcttgaggtcgacatagcaaaacgctctgacctgaacagcgaaattggagaagtcgtggggatttggcatacagtcagatcttggcggattgatggtctgcgatatcaatttcaaacaatatttagctccaaggaggtgaactaggctttgcggttagcactaacagtagatagacaaatacctcatacaaagcctttcgacgcagatgcgtgcggctttatgagaggattgtatgaggcatatccgaaacatcctcaagtcattggatatacctcaaagagattttgcattgagcaattgccgtgatgaaggttatcatcattaggccatcactgtatggtgctaagaaaggatttatgtacagcgtatagttggtcctaacacgttaagtatgtcgtgtcgagcaacctctggactcggaatactgatatacgcctttccagtaccagcggtgagaaaataacgctaatgggggcttcatattcgactttctgaatcgccagaggggcctttcggaggcaacggtgccatgataaactcctctgatccactgccgtcgtggtcaaactcattgtaaccgttcgcagtcgggcgttttctcttgtctccaccgccagcaccgaatgtcatgagcgagcccggctgcactgactcactgtgacccgtctttcgagatgcgtagccggattcgccaatcagccgaggagcaatgtgtttgaagcacttgcgtagtgtcgtcatggaaccgcatatgaccaagagattcgcctcaaccatgaaccaagtggacactttggccacttcccatgtaacatcaggagagttgagcatagctgggagtagagcagcgcgtacaattccagtgaccacggttctatattaacacaggagaaattagtacctaaaaagcccattctgatcgcatgtcacttacgctgagccaatagtgaagacagcgagaaggccaatcttacgggcagtcttcatctgcaggccgacgaccatcttgatgggaaggaccaggataatgacgtcggaaatgatattgagaaccgccgtggcaatgtatatggcagcggtgcttaaacactggccctcggtgatggtgatgtcccaacctctcgcgattggtcggcacccgaaaatgagtgtaccctccagcacgattgtgtacactatttgaaacgctatggtcgtccacgtagatattgtgaaccattgctgtgggctgagacgaaggtagaaggtgaggagggacagctttgcaaaacacccgcacgctgcgtagacggggccttggatatacgcaatctaggccacggacaagtcaacatcagccaccatccaggggatggccagttccttctcccacacaatcgagacgggataataagcttaccttgacatactctcccagaccctcaatgggcagttcccatccgtgtaaacctgcctgcttcttgacgtatgtcggcaaggtaagccccatagtgacgaacgaaagtacgaaagccatgaaaagcaagtctaagaggtgttagtccattcatcttgcattgaatctctctaatgaagccttgattgaacgtgtccggtttgcaacatacaatcgtcgctattgcacttcttgacgatgaaaaacttggtgtacatccgctgagccatgaacaacacgttaagaaaggcgaaaacggcggtcacaacgtagatttcgggtacgccacggcgctgcgggttatccaggtccacgtggtagtcctgtggtggctccagggctaccataacaccattgacaagagccatggcgcgttcatggacaggaagttgttttccgggcactggtgttcatccggcgagcttgacaaagatgttggtgacccagaaaacaggctggctgatggggcacatctaagtagggccacagacggagtaggaaagaacaaagtactacatccagacgcaactgtcaggccaacctcttttcgggagttcaaggcagatcatacgcggaagggggtgcagatcccagtcggcacctttaacgttgcatcccaggatgcgcttccttccggatcacaattttcataccctcgggagactctgtccttaatgaaagtcttatctacggaacccggtctgctagctacattctcctcgaaacgcagcacgaacgagctgcaaaaggggcggatccaatgtgaggtgggctctcccctcatccccgagtttagggatgcagagccagcttacagagtgcagtctaatcaatcgacggctcctacccgccgcttcatttagctgtcgccatggtcgtgcacaatgcattagctgaggcgtagtgggggccgattggatcctttgaatcccctctctttgacgagggtctattcttccggacaacggttgcctgctgcataaaaagaaacgaaaacggtcttcatctcagtcaatgccaatttcatcaggattctcccttcccttcttgcctagctcgattgcactattgaacctacgtatacacggctcatccaccagcagccatggctaccaccagacccaactttgacccagagctggcgcctttccacgatgcataccccctcccggccatactggcgttggaacttcttcccgtcatcagacctcagctcgatgcggcatatacggccgagtccgcccttggcgatcaccccttcacccaccaggttgagtatgctgagggcagcgacggccataaggtgccactggctgtcttcacgcccaagtcagaggcagacaatgccggagcccgtccgtgcatttatttcatccacgccggggggctgatcctcagcaaccgctactgcggcgtgggcgaggtcctgggcgtcgccgcggagatcagcgccacagtggtgagcatcgagtaccgcctcgttccagaacacccagcgccggcagccctgaatgattccttccagggtctgacctgggttcacgagaacgccgccaagctaggggtcaaccccgcaaatatcgtcgtctggggctctagcgcaggaggtggtctcgccgcggccatcacgctcctggctcgcgaccgcaagtcccagatcaagcccaagggcctgctcctcaacacccccatgctcgaggacaagatcgatgaagccgagcagaagattttcagcggcgacgcggccaaaatctggtccgccgagtcgaacgccatcgggtggaaggcatatctcggcgacgatgcggccaacagagcgaacccctactacgtaccggcccgggcggctgacctgtcaggcttgccccctacgttcctcgatgttggcaccgcagagctgttcaggaagcctgtcgtcagatttgccgagaagatttgggagagcgctggcgatgtagagcttcatgtttggcctggggccttccattcctctgactttgtggtgcctgacgctgcggtctcgaagaagtctttggccgcaaggaaggcctttatccataagattctgtcctcttagattttagatgaatttctcgcacatatatatcctcccctaccatggcattccttgataatctcgcctcaaattcgttttcatcttgccagttgactgaataagctcccggaagtaccaaccggcaccgccctgcaaccgggatcgccagctcgggggatgcggctgatctgggcactctgtcggccatgcctatgacgtgcgagcgatgattccccaggcgacaggggtcgtggctgaattcggaattatgtggcgacccttgctgtttcattgtaaccgaacgatccttctgcataaagaaaccaggttaaaggcttctgatcatctgtccatcgcgccatgtaaccctacatagtagattcattctgatttccccgaaaggcagtcgcaagtcagctgttgtagatcgtatccaggctggattacaatgcttgtgcgtacgagttaacaattcgggactgaactacctatgcacggattgcagcgaattattggtgctgctcaacgcggagaaagggaacagaacgagcctggccaaagcttcagccccagtctagcgatcccattacgctttgcgtttcgaccatttagacgcattgatgctaatgagagctaaagaacttagtcttctctgagcgatagccgttggggcgatgtaatcatcgacagccgtgttaacaacaggtttccattcaggtttccattcattggcttggctccgagatgtcttaaattttaacccctggtggtccagcctaccctaaaccagtatcttcggaaaaccacaactgcacgtccgtcagcggtttaaacggagaaatctgtttgctgcctaggtttcagttcttctctaggcataatgaataaaatatattaaatgcatcttagatttctctgatatctctgagccaatctaacgcgtacaaaaagacgtgatatcactgcgtattgtttctttaatactgaatcttagacatcacacagccagacattatatttcgatggctagtaacaacttttttctcgcttgggctccgcacctggatagctagaacattctcttgcaacaatgagtattttgtgtgccgtatctaaatccaacatgcgactgtcaccagtgatcctctccgtttgacccaatcaaggctctacttagagattatcgatgcaagaaacttgctgctgctatcgtcggggctgacacggggtagacgtagatcacagagatagcggccttcatcccagccaattacgggaaataccacaatcatgtcttatatttgattggttgagtaatcattctcctgactcacccacatacacaaggatggcgtcagatatcgaaacaggtatgccgtgtatacaaatgtgtatacaaatacaggtcacttgacttgaccgatgtaagttgggtgtgtacgggcatataggggtacaagtagacctgcctactgtacacgtcattgatttcggcagtggccattgatttttgatggttgtatattattatttcaagagacaatcggatctatgtcgctgtacgcagtataaacacagtatggggttcagataaagattagctttttatccccctcctacccgagctatcgatgcaagacggtactgctcctgttgaatctgcttgagccgtcgacggtagtatttccctccccaggttgaagagagacgagtggcggcctcctcttcggatatcaatatctgtcgtaccagtaagcctcaccacagatgggtggaacacggcactttgtataaggataatgtgacgcgcatctcggcgaatacacgggcggtcggacatttttctgcatgacttcgtgtgtcatgggtgcgctcggcatcttgattgggctacttctcagccacaatgatagatgggtttcgaaggcgtgaattcatgtggagatacgggcacgaaaatgaattgttccgagcattgacgcaagttaaatccttagagccgtgactagattctcttgtctaccaattgtatgagatgctgagtagcatcgtatgggacagagcgatgggctaatcgctgtggtataactgtcttgcaggtcaagtaatagaatccttttggtctgtggtggttatgtattgcgttcgaccacgcaccgatatcgatgtgccgctcataagcagggcactctaggatctataaccccggtgtcgatcacattcggctatgtggaagcctaatggagtaattatttggtggttgcggcagcattacccaatgatatacgaggaatagctaatagataagtagtgtaataaaggacaacaacatcccggttagtaaatgaagtataaatatagtacgtgataccccactgtctcccagggctaacttccttaaagttcgaaccgcattcgatatggaaccggatcaagtctcccttcctgtctataggaacatacttgagacattcctctaagaggcgcgttttaaactgccgccttacaaggaagatccgtcgttcgaccgagagataattgacatatgtctcgctcaagatctccccgtggatcagatggaagctgttgcacgggtcggtgtagcaacagcgagatggttttacccttcgcatgaccgagaaacccaagtggctatcgctactttcacggcccttgcaaccgcggtcgacgatcttggcgactccatggtcgaaggcttacgacaataccgcactaggcttttggcacgccaaccacttggtgtcaaagtgttgcagtctctatttgatcaagtactagagatgggccggttttatgatacgtttgcgacagatatggttttcaagggcgctgtcgaattttgcagcgccaacctagtggaaattgagaaaggggctttgttgaaggcaaacaagagtgcaccagagttcgtaaactacttccgcttgaagagcggtattgcggagccttatgcattctacattttccctgagaagttgctgcacggaagcaatccttgttgtcatctacccttgattccggatctggtgggattcatcaatgcagtcaatgatataatgccatattataaggaatctttgattggtaacgagagaggcaacgccattcatctgcacgccgctgcgaacggtcagtccgttgtcgagagtttatcggattaccagaggtcggctttagtatatctaggtagggtcagggagtatgctagcacatagttggtggtggcggaaaaggtcgaggagtttattcagggctttatggcgttccacttgatgtacacgaggtataggttgaatgaactgtgtctgtgaggaattaagcggactttatttagcgtaatcaactaacgttaattgaaatgaagtgagactgactccgaacgaaccagtctgtataaggaagtcgaatgtggaaaaaatcctgaatgaattctaaatctctctgatatctctgattctattgaaactatataaggtggctatcatttagaattgaagatcgtatacttttgtcttgatctctttttacaaccttttcccctaaacagtaaatcctagacaccgcacaggtagatgtcatatttcgatgaccactaataacttgctcttcacctgcttagagccagaacgttctcttgcaacagcaagagtattttgtgtgccgtatctgaatccaacaggtgactgtcaccagtgatcttcagcgtcagcgtgtcgccttccacagtggagaagattccaagatgtcgcgttgcggattccggatgcttgagatatatgacttgagcctcttcatccccagtctgcaccttgggcaaattgacagacccaaagtgttccacaacagagtccagttcagtatcgggttcccagtcggtgcactccttaataatctcgtccagacccattgtctctgacgctccacgggccacggattgatcttgaaccgcggtgagaagctcgtgaggcgagttgttggtgtcgagatgaactcttacggggacaatatttacacatggaccaacaacctcttgaaggccggggagcggtgaatttcgcccggaaaccacttgcccaaacactacatccttgcgacccaaaattacagagagcacgcgagcccaggcggaagataacaatgaggcgagagaaattcctgaagggaggcttggagtcgccaaggagcattccacctccactgggaccagagctgacaatgtcgattgtgctgaacgtaagttgggtcttatggcactggcttgggctcctcgcaagagctgacgccagtagcctagggcgttcggcctggaagctcttgcgtgggatatgaatagggaaaatggtatttcaggaaccaagggcttgtcttcgtacgcatcgaagaaagtctggaggatgagtgggagagacacgccatcatattgtgcgtgtgacaaacgaatcatcatatgataccctgtgacgtgtctgaagagtgtgaactttgcgaaaggagcaccggggattaatggttgtcgagtgtcctcttcaaagaactcttgtataccacttgaagcctctccttgaatgttcacaatgtttactgaaggctcaagttcgcgtaataccacttgccaatgtgctccatcgagcggcatgaaaatggagcgcagaatggaatgagttttaagcacttggtaacaagccaatgtccattgactgacgtcgacagttgttccaagacgtaaagagaagtaattgagcgccgactgaggagtcttgatcgacatctgtaggttatgttcttggaagctggtgatggggattatgtcttcgacattcgactccgcgattgcactcccggatttaagtttcccaactatgtcacccgacaccaaagaaaagggaaggagaatttctcgggtttgatcctcggtagtagtcgaagataggcaagcggtcatacgtgacaacacaggggccttgaaaatatctgccacggagagtttgaggttgttccggcgtgcctcgtttacgagctgcatggcacgaatagagtctcccccggactcgaagaaatcagaatctagcccaattgacgagctgcctacgttgagaacatgggcccaaatttgctgcagctgcctctctaaactggtagagggctggcggttcactgaagaggctgaggtgcgaagttgctcaagcctcctcgctaacaacggagcaccggttgcttgcaattccttccgattgatcttgcccgcggtagtcaatggcatctctggtagtgcaacatacaatgtaggaatcatgtggggggcgagtgaagcgctcagattctgagcagcgatccgtgggatttcaagcgtgtccacggcctcagcatcatccaccaggataaaagccacgatcttggaagcctcctcgatgacctcaacggctacatggttggagtctcgtgctgcgggaatgtactggcgaacattttgctcgatttcgccgagctcaatccgctggccgtgaatcttgacttgcgtgtccttgcggccaacgaagctgagactggagtctgggttgaatcggaccagatcgcccgtcttatagagccgaccgcgtctgcctggcccatcagggttgccagacaccaaccatgcgggatctaccacaaacgcggccgcggttctttcaggatcattgagataaccacgggctagaataggaccctcgactaggagctctccaacagcgccaaacggagcaaggacctggtcgtcgtcgggattaacgacccagcaggcgcatccaacggctgttccgatgtggttttcggggcgactttccaatctggcggaacccaaagcacagataactgttgcctcggtagggccatatgcgtccatgatgtttgcatgttgaacgactcgctggtaatcagagtccggcatactttctcctcccattaggagaacgcggaactggcgcagcgctgcatcgtcaagggtgcggataacggaaggcgtgaggacacccatattgatgccatattctatgagtcgcgggcttaggttgctgacacgatcttcatcagagagcacacacacgcaacctccgtggacaagggtggtcagaatctcgaagatcgttgcatcccaggtataggcggcgaattgaatcatgcgggtagtgtgatctacgccgattctatctccgtggtacgagcacccagaactgacagattgatgttcgagcataacacccttgggtgttccagtacttccagaggtgaacaagacgtagcaaagggaagctggagagtatttcgctagctgtccatgaggagatgcaggaagactcttgatgagctcttcgccgacagggatgactacatggtcctccccaaaattcaggtttgcattgttaacggatgtcaatacaatagtcggatttatttgggaaaggaccttctctcgtgaggcgtcttgcgacgtgttgagtggaacgaatgcaccacctgctttgaggaccgcgagcaaagcaacgacggcccatttcgagtgctcgaagcacattggcaccattttgccttgaccaacaccaagaccaacaagatggtgcgccagtctagtcgaaagatcgtccagctgaccgtaggtcagttgtccatcccaactgtagattgccggggcagaagggcgtcccaaagtttgctctgcaattagctcatgaacgcagcgcttaatatgcggcggcacagccttattgagattccattgctggcgattttcctctttactgcctatatccaatttggcaagcaagatgtctggagtggttgccaaagcgttcattgcttgactgagacaggaagcaacaattactgcttggcttgcggtcatacaggaagatttgacagtcatggtaatatcgatactgttgccatcatatgctccgtttagtgtgacatcatactatattattgttagttgtctgtgtcttctaagcatcctataaaattcttacctctgtatcatctgttccgtcatggagaacaaacctcacacccttcttgtgagcctcctcgctatcgctagaagcacgctggaatgacaacgctgtgttgaacaatgcagaagaaccaagatcaagcgtgctgtgaagatctgaaaacgggtacatcctgtgaggcaggcccttcaaatgctcctcctggactccccgcagtacatcaaccgctgaggcctcctggtctactgccacgcggcaaaccatcatgcctatcatgggtccgaaaatatcagagacgctgtcgataggaaggtctcggcaggagacgaggttaccgaagcttgtcactgaggagccagtgtatcgggatagaaccaacgcccacgcagtttgcatcaccgtggcaatggtgatatcagaccgctgacagaatttgatgatggcttctgaatcaacaccgggagttttaatggtgatgtattgcgtttgctcattggtcgggggtgcgatgctggggaagtggcatggtttgacattggccatggtctgcttccagtactcgcggtcatcatcatacgagtagccttgaagatgagtaataaactcgcggtaagaagttccttcgggcagaagagtccctgaagaagccgcttctaaatcatgaaggatgattcctgtcgaatgagcatccaagatggcatggttaatctctagtccaagtagaactcgaccatcacgcagctggcaaaccgataggtgatgttcaagggttgacttgccatatcgatctgatcccatacgagctctgaattgatccaattcaaaagtttcaccttcttcttcgaagatggaaatacttgggcttgggttgtggagaataacattgaagatgcgtgtgcttcctggcatgtccgtgacgaggcatgcccggaggagagaatgtcgctgcacgacggctttccaagcgttggcgagaccgggaatactaatttgttgcctttcttcaggtactgcctcgaaaacaaacgatgtacggtagctgttggggtccttgaattgactcatgacgataccttgctgcaagtctgagcaggggaagcagtcctccacgtcgcctggagtgaggcccagtcctgggagaacattctgctggaagacccggagatcgtcgttgcttgtgaacgcgagaggaaagtcactcaatgtccactccatgggccggccaggtagcgtctgtgcaatctccaggagggtcttttcatactgagagatccaagcttcgatacggtcatggtgcttcatattcttatcataaagtacggagattgaggcagagccgcgctcaatcgcaacgttgaagtcgaataaagcgaatcgttgatggtatcttgggcttgcggcaacgtcatctggggccgaaacgagactgaatagcgagctctcatgttcaagttgctggaatgatcccagaaagttgaacattatctcagctgggaactcattaagagcaatctcgttggtaaaggctccactgagctttgaggcaaggtagaactgattgtttgaagatccacggaggaagtctttgacgcctcggatggcttggaacaagtcccagcgagtatctctcttgactttcaccgggaaaatgtttgtaaaccaaccaacagtgcgagacaagtcaatgttctcatcccaagcctcgcggccgtgcgtctcattgtagactgaaggcagctggcgttcggggaagtgtagtgaaaaggaatagatgagagctgcgatcaagagctcaacggggcgtgtttgaaaggcgttattgctgtcacctagaagacgggaggtaacttgttcgttgagagagaatcctttggttacggttgtatcgggtgaatcggagctggaggtgatgccccactgctccaataacctggattcattctcaggaggctgattctctttcgcaatagcactttctctgaagtgatcagcctgagcgatttgccacgactgaaagctaactgccggagcgggaggggacccttggttttgaaggaggcactcgaggtcttcagatattactcgccacgagacagcatcaatgaccaggtgatgaatgcttataaataaccgctgacctttgtcattgtctattaaagcggctgagattacggggccattctcaatatcaagattagaccggcactgggagagagccgctgatatcgctgcctgattgtctgtttcgacaagatgtaagaaagaggagctaacttgcgagggctctatagtatactgttgccagtgattcgtcggtgacttggcaaaacgagcacgaagcataggatggcgctcaacgagaatatcgaatgccgcgagtaatgcggagaaattgacccgatggcgaatttttaggaaaacaaactggtcaaagaaggcttcatcatccgtctggaggctgagatataagtgttgaatagggcttaatccaaatggttgattggtagtaacttcgttgctcaatgccagagccgtcgataaattcttgctcgccgaaagcccattacaaatacggccaattgtcttcttgcgcatgatgtcgctcgtggtgatcggcaagtttagtgagcgagctgcactggcaatctgcatggcggtgatggaatcgccacccaatctgaagaagttttcatctaagctgatactgctagactctacgttgagtatccgagcccagagtgtctgaagctgttgctcagcggtagagttgggcatccgcttctcaccctggcttcttaggtctgccagctgctgggtagtgaaggatcgtgccatttcgcgcagtcggcgtcgatctgtttttcccgttgttgtcattggaagatcagggatagccaaataaaccgcaggaaccatatagttcggcagtcgatcgttcaacatatcatcgatgcgggaatcaaccttcaagacgcttaaagatccatcagaggagctctcagagtcaggcggggtgaggaataccgcgagtaaaggccgagcttcctcaccggaaggtgtaatcacctctgcaacgagctccttagcagattgagcctcagggaggcatgcccggacatggctttccacctctcctaactcaacacgctgtccgcgaatcttaacctgcgtatctttgcgtcccatatagacaagagttccattttgagtgtaagagacaagatcaccagttttatacaaggtaccagaccgtcccggataatcggtaccacacccctcgagaagccaatcgggatctcttatgaaagctgctgatgtcttgtcggggtcattgagatagccaagaccgagcagtggcccctcaagtagtagctcaccgactgttcctataggcataagcttgttgtggtcagatggatcaacaatccatgttacggcgccggcacctttgccgatatgagctgcttctgatgaatttgccgcatttgagttcactacactgttggtcgtgcattcggatggtccatatgcgttaataaccgagacatgcggccaccaattttcaatatcagattcagttgacgcttcaccaacgagaatgagtgactggagcgtcggcagctgcttcgggtcgatcagcctggcaatgcttggcgtgagcagaactaagctcgaatccattgcggctattgtttctgtgagatcattctttctctgtgattcagatggcacgcatatacagcctccggttgatagcgtgacagccgtgttatagacgaaaacatcgaagatgtacgaggcaaaatcaaagaccctggaatcagatttgaatcctagaggttctgcctggtacaagatgtttgaactcatagccttgtgagaaacaacaactcctttcggtacgccagtgctgccggatgtaaagacgatatacatcggtgactcgagatcaattctggggagtggcttcaaattggaggacactgagcgcagggctgggccaacggcgattgttgttttagcaaaccgatcactcagaggcttatgctggtccgacgagagtatcacgctagcactggtttgagagatgattgactggaatcggttttcaggataattaggatccagcatcacaaatgcaccgccagccttgagcacagcaagaatggcgacagtagcccatactgacttttcgaaacagagcggtacgatcactccagcttccacgcctaagccgattaattgatgtgctagtgtagtcgataggagatccaactgtttgtatgtgaggtcaccatcccatgcactgactgatagcgcggaggggcgtgctgtcgcctgttctgcaaagagatcagtgatgcaacgttcatatgggacaggaacatcgctgttccaagaccaaatatcccgctggtcttccggggaaagagccataaaactatccagcgtctcagatgtgtcagagttgagaagagttcgaagactctggatcgtaaagctgaattggcggatgatttgctgcgtcttccaaaggcttatgactctggcatcgtaattagcgataattttcaggccgtcgcgttcgagatagacattcagcgtaatggaatacgtgctgaaggcactctcatccgagtcatttcgccatctgcccacatctgatcctcccaatgaatcttcgtccggcggttgaacaattaggagtgtctgaaactgggcagcgtcgcgtgcgcttgagctcaacttcgcgatctcttgcaagccgatctgttcatatggagtcatttctgtagcctggttctggacagcgcgaagcacggccatcacagacgaatgagggtccaggcgaacgcgcacaggcactgttgcgatggttgggccaacaattgactcgattcccgctacaggagcattgcggccagacacagtagcgccaaagaccacgtcatgatcgctgctgtgagtgcttatagtaatggcccaagccgctctgacgatggttgcaagagtgaagtccgattgctctgctggcggaaccgcacaaaggtgctccagaacagaatctcccactgggtctcttgcgtgcggtgggagcgggggaaagggagctgagtgataatcggacagttccgatcgccaataggactcactgtcatcccgtgcttgttgaatatgttgaatgaaagaagcaaaggcgaaattggtcgtcggccgaaccccattgtacaagctgtcaactaggtgtagaagcatctgtaaagatgcaccatcataaatggcgtgatgaacagtcagcacgaacatcgatggcgtccctttaatgacttcaaattgtgccaggggctgtccgagtccatatgttgtgggcttttccggctttacccaattatcttgatgcttgagcacaacttgaagtagtccataatcagggttgtgaatgattctcgtacgtaacaccgctacagcctttgtggcttcattccaggcgttgatgtaccgcgagatatttgccgtctttgagaaggtcagagttgcttggaaagtataagcacctgcttgcttgtcagtgagggcaaggagaccttcttgcagaggtgtgcaagggtagatatcctcgacctcgccaggcgttacaccgcagttggtggcaatatcagaaagttttactgattggaagaagctagcgggcagcaaggtaaatggatgagcggcttctgtgtcgggcttgaggagttcttgaccagctagttgggccaatgcggccagccttggatggcggaagatgtcttgcactgatatagcaatcccttccttcctggccgtactgaccaacttcatcgcagaaatcgagtcccctccgagtcggaagaaactatcgtcaataccaatattgtctggcttaacttgaagcacatgggaccaaagcttctgtagccttttctcgatctccgttgcaggctgccgcttgtcgccagtgctcattgtcagtaaatcggccagttgatccgttgtaaatgcacccgccatctttcttaacgagtttcggtcgatcttccccgaggttgtcaatggcatgtcgggtattgaaaagtatatcgaaggcagcatttgagcaggaaggtggtctgcaagccgatcttcagcatccgaggacactgacaacacgtgtagtgagttaccctctgctgtctccttgttcttgtagttcactctccatgtggacaggaagacggcgagcatggggttggcctgctcccctgacggcatgaagacttctgccgcaatgcatgaagcatccttggcctctggtaagatctctcgggcataatgttcaacctcgccaagctcaatacgttgccctcgaatcttgacttgtgtgtccttgcgcccgacaaaagttagactaccgtcttggtggtagcgaactaaatcgccggtcctgtagacaatgccattccgcccaggatgattcgctgtaccagccagcaaaaagcaaggatccttaatgaaggcctctgcagtcttgttgggatcattcagatatccaattgcaagttgcggtccctcgagcagtagctctcctatagtaccaatcggcgccaacttattataatcatcaacgcttacaacccatggaatcatccccactcctttgccaatgcgagttacctctcccgggacatgcgaatcgtaattgatgatgctctggatagtgcattctgcaggtccatatgagttgatgagtttaacgcgaccccaccaccttgacgtatcttcatatgtaactggctctccgccaagagtcaacatttctaaaaggggaacatcttctgggttgatcaggcggctgacagatgctgtcagtgctgctgttgttgctttcattctgcgaatcgagccagccaagtcgttcttccggtccacctctgatggtacacacacgcagccaccagttgaaagcggaactaaggtattactgatgaaaacgtcgaaagtggttgccgtaaagtcgaatgcccgagtgccttggcggaacccgagaatgtcggcggaatgatagacattagaggcaaacgcttgatgggaaacaacaactccctttggttcaccagtactgccggacgtgaacacaacgtacataggagacgatggatttgtcaagggcaaggcgacactcttatcatcctcagggattgtttcaggtccaattgcaatagcatgacctgttagacgtactgcaagcgagagactttgactatcacatagagtggttcctgcctttgtgtcctggatgatgcgacgtagtcggaactctgggtgggtagggtctatcatgaaaaatacgccgccagctttgagaaccgcaaggatggccactggtatccacattgacttttcgaaagacaaggggaccatatcgccaggcctcacgccggataggatcagctgttttgccaggcgtgtggacagctcgttgagacgccaatatgtaagctctccatcccacgcgctaatagcaagagaattaggctgagatttgacccagtcatcaaaaagatggtgggcacagcgctcagatacgcaagggatggtgctgttccaggaaaatatcctctccttttcatccatcgaaagagagtccacagctccgatcaagagatgacattctttaacaagcgtattgactatcttactcaaggagtcggcgaggttggacacatggactccggagaggaagcttgaccgcgcagatactgagatatctaacgctttgttttgctgcaatacactgacggtgacggcatactagtattctgttagcttgtataataaaagccgcggcgtctaccacttacctctgtcgggtcactccaatcttgaggaacgaccagaaggttggaatcttcctcctcttcattggaatcagatctggtcagggaaataccagtgttaaataaagccatctggttgagcccgagagacctatggatgtcaatcaatggatacgactggtagggaatgctctccacgtatgtctcgtgcgcggatcggatggtgtccaggatggtctttgtggcatcaagttgaattctgctggtgaaaatgttgatcaatggaccgaagatttcgttgacttgatcaatgtccaggtcgcggcctgaggtcaagttgccaaaacaaggcgactggcaacccgtgtaatccttcagaactaaagcccatgccacttgaatgatggtagaaagagtgacctcccactgttgacagaaggcatggattgcgtcaacatctagaccaacgacctctgcagatctttccctcacatcatgatctggtgtctcagatagctcagggaatagacagggctcagcagcctccaacgcaccagcccaatatttctttgcttcttcatggacctgttgttcgaagaacacggacacgtttctaaaagacggagcctctccatcaagcttttgaacgtaagcgtgcttgagatcttcaagaagaatgtcacgggaatgggcatcgataatggcatgactgatgctcaagcatactgccactgtgccatccttgagctggcatagtgcaagatgatgctgtagacccccaagatgttgctgagtggttgcatcgtagtgcttttggaattcatcaaggctcatgctttcgccttttgtttgcaaaatcagaatctccggttgagggtctcgaaggataatattagccagctcatggttgccgggcatgttgtcgaccacaacagcacgcagtaacgcatgacgacgaacgaccttcttccaagcattgcttagtctattgcaatcaatttcactgccgtcaacagcagccatggtagagagagacacaacgcggtagtttcctgagtccttggtctgactaaccaaaattcctttctgcatgggagtgcagggaaagacatcttgaacgtcatcatggtcaatgccaagactaggtagggtgatttgagtaaagtcgtccagttcactatatgacttgaacatcaatgggaaatcagacaatgtccactgtgctttaatgtgggaaagttgttcaatcatctgcatcatggtatcgctatattgcctagagaaaatagccgccttcgtgccgtcgatattgcggtcgtaagtgagtgagaactttgcacagccttgttcgacgatggctccaacatcgaaaagcgccattcgtttgttcggtgtgggagacgagagtgagtcgatgtcatctgaaatgggaagctgtttgaaaaacgagtcgtcacgctcaagctgctggtagacacccacataattgaagacaatctctactgggaaagccttcataaaagatagggcttggttctctgacacaaactgtgaggcaaagtatcgcagattattgtccttgcgactgcgaatttggtcttttgtctgtcgaataagttccagcaagttgcttccagcagatgggaagaatggaataaggcttgtaaaccatccgacagtctgtgaaaggtcgacactatcatcccaagtctcacgtccatggctttcgttgaaaattgtgggacattggcggtcacggaatgcttcattgaaggaggcaacgaggccggcaatcataagctccatgggtcgagttccgaaagcatcgttagaagcccccaacagtagggcagtggtggcctgatccaactcaaacttttcagtaattgtgatgttgctcagatcctctactgacccaataccccagtatgcaagcattgcagagtcttgtgagaatgggatgtcctgagttggaaaggtgttttgagaaacgtgtttgacttgtaagtcgcgccaggcccggaatgtcagcgagttattgggtagcagtgggtgggataatactagagcttccaattcttgtaatatcacgcgccaggaaaccaaatcaatgactagatggtgcacggccatgaacaaccggggcttctctcctgagggaaagtaagttgcggacaacaggggacctgtctcaacattgatctgagcacggcattggacaatagactgagtctgttcttcctcattttctgcccccgatttctgcaatgcaaatgattgctgaacatttttggagatcagttgctcccatttgccattgggactcttcccaaagcgggctcgtagcatcgaatgtcgctgcacgattgtagtaaacgctttggacaaggtagaaagagatacctcgtccttgagctccaagaagaagcactggtccgaagtgccaggtgcctgttcttgaagatgaaaatataactcttgtatgggggttaattcaaaaggttgttcctctaactcctccctagcatcgatcagtggctgtgtcttattagtaacaccggcggcgatccgggtaattgtcttcttccgatggagatcggtgacggaaacctgcaattgtagggaacgagcaagtgctgaaacttgcatagacgtgattgaatcaccgcctaggcggaagaagctatcatccattccgattgacgccgtgcttaagttcagcactctagcccagacctgctgcaactgttcctcgatttggttagctggcatccgcttgcggctctcagatttagaatgaagatctgcgagctcttgtgaagagaaggaagagatcaatcttcgtagctctttacgatctgtctttcctgttgctgtcatcgggaggcgagagagggtaaagtacattgtgggcaacatataggctggtaggcgctctgccaatgcatcatccatttctcgtgagacgccaagtactcccaagcccgcatcacctccggcgttgtcaactgattgaccggtgcccacgaaaatcaccaatgttggagaggcaccagctgggacgacaacctcggcagacaacggccgtccccgatacgcctcaggtaaccattccgagacgtggtattcaacttctccaagttctacacgttgtccgcgaatcttaatctgagtgttcttacgccccatataagaaatggtgccatcggggtggtatctgaccagatcacctgtatggtatacagtgctctgtcgccctgggtgattaggggcgccttctcgcagccattttggcgctgtaacgaaggcttctgccgttctgtaagggtctttaagatagccaaggccaagtagtggtccctcaagaagcatctcgccgactgctccaatgggtgctagttgatcggagttttctgggtcaacaacccaggtgatagaaccaatgcctctaccaagccgcagcgcttcgagggcagttttggcttccgtgttgagcagactgagcggcgtacactcggaaggaccgtatgcattgatgacgatccgatccgcgccccgccatttcgtaacgtctgagatattgcagggctcaccaatcaaaagaagggttttgagcgatgggacctcggatggctgtattgtccgggtgacactgggtgttagaaatgctagagtggcctccaagtctgcgattgacctggcaagattgttcagcctatcctcttccgatgggatacagatacagcctcctgtagccagtgtaatgacaacattcatgatatatgcatcaaagatgtgagcagcgaaatcgaacactctcgtctcaggtccaaagcccatgacttgatattggtggtgagtcatggttgagaatgctccataggggacaacaacgccctttggctcacccgtactgcctgacgtaaacaccacgtacatggggtgtgcaggattgatcgatggtagtgggcatggtctaacactattttcagctaattcagcttcagggccaacagtaataactgtgtctacaaggcttgaacttgctacacgatgagtgaccgatgagataataaggcgagcatcagcctgtgagatgattgaacgaaggcgggtttgaggttggcttgggtctagcatcatgattgttgcgccagctttaagaacagccaatactgccactggagcaaacatagacttttcgaagcacaaagcaatgttctccccgggtttgattccaagttgaatcaggcgataggcgagttgagttgaaagggtgttgagctgactgtatgtcaagctaccatcccatgcgcggatagcctcaccgctgggtcgggtatttatctgctcatcaataagatcatttacagaacgctcagccgtggcgggaaacgcctgattccatttccagacttgatctctatccgtatcgggtaagggatttagggaggtgatctgacggtcagggttgttgacgagaagattgatggctttgctaaacatctcagctacgttgctggcctggcttggatctagacaacccgatttgtaggcaatctcaatttgaattgatttacggccaagtccaacgtagacaataatgtcatactaaaacgaggagttagttatcaattggttgatcaagaaaacggggggcttagactaacatccgtcggatcagattcgtcaatcaggcgacacatcaaatcgctactagacgccacttctgtcgcatcaagatgtcgcagggtaaagattgtgttgaataaacccttaccctccagtcccaaaagtctgtgaacttcataaagagcgaaagcctgatgctccaggcttttgacgtagttctcctgcatcgccttgagagtatccaaaacggtctttccattcacaaagtctacacggcaagtcaagaggttaattagagggccaacaatcccctcgatgccatctataggcaaatcacgcccagatgtcaggctaccaaagtatgtggtcttcaacccagtatatcgggatattaccattccccatgcagcttgaacaacagtggctattgtgatctcccaatcttggcagaacgcgtgaatagcgtccatgtcgaggcctaccacttgggctgtatcggttttgtcaccgacgccggccgactcatcacattgtggctccgcgagggctggaaacaaagagggctccgcatcatgcaaaagctccttccagtggtgtcgagattcttcatgtgactgagtgtccacgaacaaaacgacattcctgtacgatggaccattcgcgctcagaccctttgaatatgcgacttgcaaatcatgaatgatgagatctcgactgtgtgcatccgtgatggtgtgattcatgtccagttctacaattgttcttccattctccgatacaccgatggtgaacgagtgctctagaacttggggtgttgcggttgactgaagggaaactgcactctttacctcctcggtagtaacattatcgatgccagggcctaattgaaccacagacatagctatttctgggtctcttagaataacatggccagatgccgaactgccagggagattttcaacgacgatggcgcgaaggatcgggtggcgtcggacaactgctttccaggccttgagcaacttttcaacatctactgaatcgcccgaagcaaggctcacttcgaaaagaagacctccgcgataagagctagagtccttggcctggctagctatgagcccttgttgaatgggcgagcatgggaacacatcttcgacatcgtctagggttatactcagagctggcaaaacgctattttggaactcttggacatcgcgataagactggaatgccagtgggaaatcagccaatgtccattggcgtgtgttgactgcatggagagccgcagcctcagtcagcttagctttgtacacctgggcccatgtgctgatcttttcggaacctttcaaggacgggtcgtaagtaatggcaaattgagcccgcccattctccacgaccgcagcgacctcgaacacagaggacctagcggggccgctattattttcctggcatgtatccgggaggggtaggttgtggaatactgcatcgctgcgctcgaactgctgatagacacccatgtagttgaattctacctcaacggggaatcctgagacaaagttactagcagtctcgttgtcggcaaaacgagaagcaaaatattccaggccgttatgagtgaacagacggaagcaatccttcatttctcggatggactgcagcagatccctgcttccatcggacgatatctgagcagggaacatggtggtgaaccaaccaacagtctccgatacatcgatgccatcatcccatggctcacgcccgtgaccctccacatatacggccggagactcacgatcagtgaagacgctcgagaatgaattaatgagcatggcgaccataacctcaataggacgtgtctggaacacatcgttgcagctaccaagaagttgctcggtgatgtcctgattgagctcaaatttctccgtcttacgtgcaatccaggtgttggatgattgaatttcccaatacgacaattcggctggtctcagttcgaatggaatagccttgatgggatcaatagactggatatgttgggtttgtcccgcgagccatcgtcggaacggatacgaaaggtttggaggcaacggacgagttgcgagcaggttttcaatatcttgcagtaccacacgccaggataccaaatcgatgactagatggtgaacagatataaataaagtactgtcgcgtggaaagaatgctgctaccacgttgggtccattttcagggtcgagttgacttcggcagttcgaaatgacctggtctagagaatcattttcggtttcttgaatgttgtgaagaacaaaagatgcttccacatcggcggagatgtgttgctcccagccccctgaaccatttcttgtgaaccgtgctcggagcatcgcatggcgttgaataacagcggtgaaggcggacaaaagtgtttcatacgcgaccttcttgttgatgcggaggagaaaacattgatcgaagttcccaagctgcccaccctcaagatctatgtgtagctgctgcatcggtgacagggcgaagggctgctctgactgttcctccggtccacctttattagtgtccttttcagcaggtagcatagacgcagcttcggaggccagcctataaatggtctttttctgaagaatgtctccagtggagagctgcactccaagctgacgtgctcgggctgagatttgcatcgcggtgatggagtcgccgccaagccgcaggaagctatcatccacgccaattgcggacagatcaagcacaaggacatcagcccatagctgttgaagtattatttcgacctcatttgatggctggcgcttcaagttagaatcatcggtgctgagttcgctgagttgcttcgctgaaaaagtcccagccatctctcgtaaacgcttacgatcaatcttgtgagatactgtcataggaaggcttggaagaaggaaataaactgagggcaccatgtaggaaggcagacgttcggcgagggcatcgctcaactggttagacaccctcaatacctgtatcgagtttccagcctccatcttgatcctgggattcgagaggaaaacggcaagtaatggattagccttgctcccagacggaataataacgtctgcagctagggcatccgcatcttttgcttcgggaataacacttcccacgtgatactcaacttcgcccaactcgacacgttggccacggagcttgatttgagtgtctttgcggcctagataggcgagacttccatcctcattatatcgaaccagatcacccgtcttgtagagggtgcctgtgcggccaaaatgttcggtcagccattttggcgcttggataaacgcagcagcggtcttccttgggtctttgaaatagccgtgaccaacaagagggccctcgagcaacagctcaccagcagttcccacaggttgaagtctctcgtggttggttgggtcaacaatccaggtcacagcaccgcacccgcggccaattccaatggcctcggcagggctcgtagcattccagttgataacactggtacaggcacattccgaaggcccatagccgttgctgaatgtgacatgtggccaccatttctcagcatcagataagttgagagcctcaccaccgaacaagattgtcttcagagatggtgcgtcttcggggttgacgatcctgctaagagtgggtgtcattgacatgagtgtcggcttcatgatagacattgccccctttaagtcgttctctcgctggaactcagacgggacacatagacaaccaccagtagacagagttacaatcgtatcgaagacgaaatcatcaaacacttgagccgcaaaattgaacacccgagagtctttacggaacccaaacttctcggcctggtgataaatggcagacgcaaatgccctatgagggatcattgtgccttttggcacaccagtactgccggacgtgaagatgatatacgccggtgattctgtgtcaacctccgggagcgtgacttttgactctgttacgtccacgtctggcccaagttccaatacagtatccgcatactgttcacattgggaacgagctgatactgatgacacaatgagcccagacccagcttgttccacaatcgtttgcattcgagcaggtggatagtcacggtcaagcatcaaaaacgttccgcccgctttgagaacgcccacaaccgccacagacgaccacattgatttctcaaagcaaagaggcacaaccgttccttttttgacccctgcggcaatgagcttataagctaagcctgtggagagtctgtccaggtccccgtatgtcagctctccatcccatgcgcagattgctggggcgcttggacgagctttcatgtggttaccaatcaggtcgtgaagtaaaacagagtttgcttcaggcacagtctggttacatttccggagcgtgtcgatatcggtcggcataatggtggcgatttcgtcgattgtctgcatctcatcacatgtagagagccgttccatggaataacagaattgtttgataatttgggacatttcccacgggccaataattctggaatcaaaagcaacagagattttgatcttatccggactaatggaacaagagaaggtgatggcgtaagttccaaaagcctggtcttcagacaatagatcccaggagccgagacgtcctagctcattgaatgaatcttcatctgattgctcaacaaccaggagggtctggaaatcacaagcctcccgggcattttcgttgatcttcgagatgtctgaaagcccggtctgttcaaatggaatcatatcagtcgcttcatcctggacctgctgcaagtagctgactgctgtttgtttagggttgatcaccacgcggaccggcactgtcgcaatagtaggagccgcaatacgctcaattccgctaacgggtgcattacgcccagaaactgtagcaccaaaaacaatgtccgtagcgcctgtgtaagagtgcacaacagttgcccacgcaccttggatcaatgtagctagagtagtgttggagtttgtagatcgcacacgcttccacacgtggtccatggttgagtctgacatcggcttctcaatagaagaaggaggtgggaaatgggcagcttggtaatcggagaattttgacgtccagtactcctttgctttatcatgcccttgctgaagaatatgctgaatgaaaggccgaaagtcgccatagggcgttccaggtcggctcatatacttgtcctgcatgacctcgagcatcattggcagagactctccgtcataaattgcgtgatgtaacgtccagacgaattgcctcttgccagttgtaacatcctcgatgagtgcatatcttgctaatggcattcctagttcgattggcgctgttaagtcggactgaatgtagtcatcgatgtttctagctcttctccattgaatagtatccttgacgacgacctgtagcaggccaaactttccatactgaatgattcgggttcgcaggacaggtatttgctgtgccgtctcctcccacgcttcacggaactgagaaaggtcgacgtctggagagatatcaaggacagcttgctgtaaatacttgccctgggtcgtgctggtaatggcaagaaggcctttttgtaggggagtgcaagggtagacgtcctgtacgcagtccacgccgccgcacctctttgcaattttgctcttgtggtcatcaatgtcgaattcagcccccattaatgaaaatggcaagataatgtttgcttctaatgaagagatcttgacagccagttgggcctgtgctccaagccttgggtgcttgaaaatgttcatgacagagagctcaacgttgcattcagagcgagcctggctgacaagtctcatagccgtaatagagtcaccacctagccggaagaagttgtcaccaagaccaattgtattgggttcaatcctcagcactcttgcccaaagattcctcaactcgatctgaactggagtcgacggcatctcttttcggccttgtgatttacttctcaaatcagctagtttttgtgtagaaagcgacgccgccatttcgcgaagccgcttccgatcggttttgcccgtgatggtcattggtaactgggggatcttgaagtacacggatggcatcatgtagcttggaagctgacgttcaagaatatcctccacctcgctggttatggctaaaacagtcatctcgccaccatccttcgtttccaatgtcgttgcagatgagaggaaaacagcgagaaacgggggactggattggtctgctggaagaatgacttctgcgagcacttgcagctgttgagcgtcagggacacactggcgaacgtggtgttcaacctcccctagctccaccctctgcccgcggatcttgacttgggtgtccttgcgcccaacatagtcaagggttccatcgtcgttgtaccgaaccaaatcgccggtcttgtataggatgctgttccggccagcttgtttgtcagtaccacttaccagccacttcggactatcaataaatacggctgctgttaagtctggttggttcagatatccaagtccaacaagagggccttcgagaagcagctcgcccacggttcctattggcatgagtcgatctgaatcttcaggatcagtgacccatgtgaccactcccactccttgaccaatcctcgtatctgatgcggcacgagaatgctggatgtgaagtacagacgtgggcgtgcattccgcagggccgtaggtgttgataatttggattctggtcgggatccttgcaaggtcgtctgtttgcacagcctcgccaccgaaatttagggtgcgcaattttgttagtctctcaaaatctacaatgttagctacagaaggggtgagttcgaccatattcgcctccgtcttgcaaagagagtcctcgagggtgttttttcgctcttgctctgaagggacgcacaagcaacctccgtttgcaagagtgttggtcatattgctgattgcaacgtcaaaggcatacgaggcaaagtcatagagacgagtcgaagaatcaaatccaagtacagtagcctggtaatgcgtcgctgaaaccatggcacgatgagatacaacggccccctttggaattccagtactcccagaggtaaagacgacatacatagcttgttctgggttgaccacgggcaattcaactaaactgggtgtctccggtgtcaggtctggcccaacctggattactctgcctaccaaacgggacatgagtggtgtgcaagacgtagaggctaggacgacgtcagcttgagcctgtttcaaaatagagctcaagcgagtttcagggtgagagggatcgagcatcagaaaagcgcatcctgctttcagcacagccaacattgctatggcggtccacatagacttctcaaagcacaacggaataactgtcttcgtctggacccctatgtcgaccaaatgctgagctagccgtgtggatagacaatccatctccctatatgtgagcgtaccgtcccaagctgagattgcttgggcattaggtctagctctaacctggacagcaacgatgtcatgaaagcaggactcttctgcttgtggtataatggagttccagttccagatcttttcttggtcatcctttgttatcgttgtcatctccgaaaccgtttgctctgatgacgcctcaacgagaagatgcatgacatggcagaattgaccaagagtcctttgcacatctgcgtgaggtataacatggggatcaaagaccgccttgatatgcatgcgatcagggctaatagaacagttcattgtgagagcataagtgctaaatgactgctccttggagcaaatgctccactctccaaactcggaagatgcaaaggagtcctcatccggaggctggacaatgaggagagtttggaagttacaggctgcctttgtacttttactaatcctagaaatctcatgcaggcctgcctgttcaaacggaatcatctccgtagcctgatcttgaatcatcctgagataatccgaaaccagctgctgaggttgtatttgaatacgaactgggactgttgcaaacgtggggcctgcgacctcctcaatgcccaacactggtgcactgcgacctgctgatgtagccccgaacacgacatctgaagcgccgccatgaatgtaggaaactattgtccaagcagcccgaacaagtgtcgccagggtgatatcggtattggcataggtgtgtgtccaggtacgctcaattgccgcatcggcaacggtctcgattgactgggaagttgggggtggaaaagggattgagttatacccatcaagctgtgaactccagaagctgaccatttcctcaggtttctgtgatacaacaaaatgcatgaaatctctgaagttgacgggaggttttgaatgaatcgagttatagttgtcgctcaccaacttcagggtaggttgtagggaaacgccatcatacaccgcgtgatggagggtcaacacaaacatggtttcgtggtgctggcgaactatcgcgtagcgagaaagtggttgcccaagctctatgggtctttctagatctgatttgacgtactgatccaggtcatccgcgtgcagccagtcgaatccggtttttaccactacctggacaaatccgaggtccttgtgttgtattatcctggtccgcagaatggaaaccgaactcgtggcatcctcccaagcctttttaaaccggtttatgtcaatacttgaagctattttcaaaacagattgtaagacatagtcgccctgttgtttactggtgagagcaagcaggccctcttgcagcgagctgcaaggataaacatcttcgatctgagactcctcgacgccacaggcaagggcaatatcaggggaatgcttttgaaagctaaatccactacccataagagagaacggctgaatatcagcacttgtcacggttatgggtgcatttgcctcgaccaacctggccaaattagccagacgcggttgtttgaatatgtccattgcagaaacacttaatttctcttttcgagcctcagcaacaagtctcatagcaatgattgaattaccaccaaggcggaagaagctgtcttccagcccaatagttgcagcctcgatgccaagcagtcgggcccaaagactccgcagtctcttctcaacatttgtggaaggtgtgcgcttgtcgccttcggcttggctacgtatggtgttcaggtcctgaatcgaaagcgaagagatcatttctcgaattctccgccgatctatcttgccagttgctgtcataggcagcccgggcatcatgaagtaaaacgagggaatcatataagttggtagctgttccaccaatgcatcctcagccttactgtcgattgtgcacacgtccatcgtcttattcttcgtacccttcgaagaggtggacatgaacacagccaacagtggatgtgctcctttaccacttggtcggacgacttcgactaccatttgctgagcgtgtttagcctcgggcacatggcgacggactcggtgttccacctcgcccagctcgacacgctgaccacgaatcttcacttggtaatcttttcgtccagccgatgtgatggttccgtccgcattatagaagcccaggtcgccagtcttgtataccacacctcgtcgcccaggatggttggcggtacccgctaccaaccacgtggggtctcggatgtatgttgatgcagtcctctcagaatcattcaggtatccattaccaagcatagggccttccaggacaatttcaccgatggtcccaataggtgcgagtttgtcatggtctgcagggtcgacgatccacgtcactgcaccatatcctcttccaagacgcattatctgctccggagtctcatactctgggttgatgagagaatggggcgtgcattctgaaggaccgtatgcgttgaccacgtgaacgcaagctccccactccctggcaatatccagcgtcatcgcctctcctcccgcgacgagtgttttcagggtagggaattctttgggattaagaagccgagcaacggaaggcgtcaaaatgatattcgttgtttccatggctctaatcgagtctgccaggttgttcttgcggtcatgttctgatgggatgcaaacacatccaccagtcgcgagcgtcattccgaagtcgtggacgaagatgtcgaagattgctgctgcaaaattgaaaactcttgacttcgaatgatagccaagaggctttgattgatgaagcacgtttgtacagaaagctcggtgagatacaagggcgcctttgggtgctccagtacttcctgatgtgaagataacgtacatcggggatgatgggtcgttgaccggtaacgtcaagtccttgtcagcgcgaggagggtgacttgaccctattgggatcgccttcggtgctattttcgatcctatttcatagcaagactcagatgtcaatactacttgggcgtctgtttgctccacaatagaaagcagcctgttttctgggtgtgttgggtcgagcatgagaaaggcaccgccagccttaagtacgcccagaacagcaacaatgcaccagacactcttctcaaagcaaaggggtacaatagttcccggttgtaaatcacaatgttgtatgagtgcggtggccagcgctgttgacatgcgatctaattgtgcatagctcaaatctccatcccaaccacaaaccgctggagcatctggctgtaactctgcctgatcctcgatcatattgtgaagacaacgatccagagcaggtggtactttgttgttccacgaccaaattcgatctcggtcctctgggctcagcatctcgatgtctccgactcgtgactcctcgctggaagtggccagctgctccatcacggagcacaatttctccagtagtcctttgacagtagcctctggcaggacttttctgttgtagtcagcaacgatcttggttgaatgttcgtctaccatatagacttccatgttaagactataagaagagttgcccatgctctcctttcctctagtccactctcccattttctcatctttgaataaaaattcgtcgccagcttgcacaatgataattgttccgaattgacatgcgctctcggtgtgagagttgatctggctaatatttgccaggccaaagtgcgagtatttttctcgcggcgtgttctccgtttcaattgcgcgcaagtaatcgatcacaagcgggttctcgcccatctgtacctggacaggcaccgtcgtgatggtagtgccagcaacaaacttgactttcggtaagggtattctcctcccagacaatactgcaccaaacacagcttcgtctgctcctgtcaatgacctgaccacaagaccccacgctccgtataccagtgccgaccgtttaactttgagccccttcaacgaaacgccagttgattcatactccatgcgtgttaacgatagaggttcgtttatagatacctgggaggcagggaatttcacagcgtttccgcttgtagcctgcctccaatactcctttgcctcgctcatgtcctgctgttccaaccagtcgatgtaggccttgaactgtaaagggggaccgcgggcagtgccgtgataaagctgcgaaacataggccgtcgctacaacagcggaccagccgtccagttgtgcgtgatgaaccgaccaaacgaagatggcattctggccatccttgggtgtgatgatagcatatcgtgaaagcgagccaccgagttccagatccttggcttgcctctgctccagatattgcttgatatcatctgcctcatcccattcgggctcctcgcgaaggacaacctgcagtagtccatagctctcatgatgtacgaacctcgtccgtaatgattgaatgtcgcgatgtgcctggctccagctttgtcgaaaccgctccaagtccacctcagggttcaagtcgaagcgagcgtggagcatgtaattaccttgtttgcggagggctaatgacagtaggccaatctgcatcggcacacaagggtaaatatcctcaatggtgtctgcatcgaatccatacgcagctgccatttcatctcgaatgtccatccacccaccgggtggcttctgggcgtcaagggccctgtcgctagacgtggccatctcctcagagtcgctactcattattactttgccgttattgtgttaatctagagttgacgactgaaaataattaataatactacagtatcagaatggaatgcaacacgattgagttgtgtgttaacctcaaatgagatattctggttctcgaccctccagattcagggctccctctctggtttggtcatcacttcgtcttattgatcgattaccttggccgcttacaaccacatggcattgaggagatcggtagttggatctgattattgcaggggtagggggtgtagaataaaaaagaaagacaacacccctgtgcttatgcttacaatgcagccagacctcctgattatgcttaccaccagagtactgctgcctttgaggacccagaaaaaaacaaagaacggaaaaatcgtagtcttgagggctgttgcaactctggccagagttaggttgacactggttggcagtcgcgtctatcgatcgctgaaccctgttcccgctggaggattccaaccgatcggtccaccaagacgcgtaagggggatcagtcaacggggcacacgtctcgtggagctttgtcctctgatcgtggctcgacgctggctggaatctccaagcattctccatgtcgccaacgatggacacctgccgcttggatgccgacgataccttcgggcccgtcgtatctcactgtcgtggcgggttcgacttcaccctgctgttcgagcaggctatcctctccattcttccctcggtgctcgtgcttgcagcatccgtatatcggctccttggtctccgtcgccaatccattaagaccatcaccaagtcgcgtgcaccttggataacggcaaagcaggtaaactatgccaatggtgagtagaaccaaacaagcagtcactaatctatcgctcgtaatagaccgccatcggaggctatgcgatcacgcagctggttctggtaatcctctgggccatcccagaacacgatgccaccaaagtgtcagtagcagcatccgccgtctccctggccactgctatagtattctccagactgtcatacgtcgagcacaaccggtcagcggagccttcaggaatcctcaacttctaccttaccttctcgattctcttcgacgtcgcccaagcgaggacgctatggctccgaggcaacagcaccgccatctctgccgtcttcacggtcggcattgtgctgaaaatagtcatgctgggcgtggagatggtcggaaagcgcgggattctacaggcaccgtatcgagactggtcaccggaagcgctaggcggcatcatgaatcgaagtgtcttctggtggattaattcgcttttgcacaggggccatggttccatcctcaagcagagtgatttgtttcccttagacccagacctgcaatcgcttcaactccgatcgaaattgatacaggcttgggaaagatccgacaagaaaggccctcactctctgttattcacaaccattgtctctttgcggaagcccatgctggaagttgtcatgcctcgaatcgccctctcggctttcaagatctgccagcccctgttggtcaacagagcggtctccctgttatccgagcctgcgagccagagaaagactgatgtaggtcgcgccttaataggtgctactgcgctcgtctacattggtattgcgataactacggcaatgtacaagcataaaacatatcgctatatcaccatgatgcgtggcgccctggtatctttggtctatgacagaactctgagcctcaatttaggtgccgtaagcgacggagcggccatcacgctcatgagtacagatattgaacgaatcgcagctggctttgagtggacagacgcactctgggccggaccgatcgagctcgccattgccacctacattctttacactcagatcggctattcatgttttgcaccactaatccttagcattagtaagtttctctttcctcttgacctcaaaatttgcagggtatctaacaaggtgctacagtattcctcgccatatggggcgccctctctggagcctccgccaactatcaaatggcttggatggaggctgtacagagccgtgtctcgagtgccgccaatgttattggtaacatgaagggtatcaaaggctccggcctgtcggatgtctttgcagctgacctccagagactccgagtggacgagctcaaggcttcttccaagttccggcagatcctggcgctcttctccattcttggaaacttctcaggcgctgccactcccgttctcactcttatcatttacatgcttgtcatgagggcgacgaccagcacagatctcgaccccgcagtggcattcacgtccatttcactggtctctttattgggcgcgcctgtccaacaattcgccatggccctactcaaccttgctgcggcgactggctgcttccagagaatccaagaatacatcatttccaccgacgagcagcgagactcatcttctgacctgtcattcacatctgatctcaaggacaccatacaggttcaacttaaagatttgaaatctgacgcagatgggcctcatcatgatcaaaatatggtgcatgtagacagcgcgagcttcagcttcacccccgatgggcctacgattctcaacgacatctcattgactttgtcacccggctcatggacagtaatcactggtcctgttggcagtggcaagagcgctttactcctcgctctcttgggtgagatgcacaagagccagggatccgtggacttgcacccagctcgcatggctttctgcgcacaggatgcatggcttcccaatcaaagcatccgctctcttattattggcacatctgaattcgataaaaatctttattcgaccattttgagcgcctgtgaattgcaccaagacctcaagattctatctaaaggggatgaatctgttgttggaagcaaggggacgagcttgagcggaggccagaagcagaggattgctctggctagagctctttacgcgaaacctagcctgctcctgcttgatgatgtactcagcggtctcgatccgaccacagagcgccggatagtcgatagtgtgtttggcccacagggaatttgccgcaaaaacaacacgactgttctattggccacgcatacaggtgagataaccatccccagtctctacgaagtcaatcgctaacacctgagtggttttctctagtctcggctgcaagggaggccgatcaagtcatcatgatgggtaccggaggtgtaattatcaagcaaggctcaccagcctcgctagacttgatcagctctgatagtgacatcaaggagagccgtacgccggtagaagaagtcagcgattctgatactccagcacacgcaccaggtccaagcgccccagcaatggatccggaagacctgaacaaaaaggaagcagaggacgatctcactcgcaagacaggagatatacgcttgtatttctactacttcagaagcgtcggctgggtggttaccactgtgttgttcgtgagctgcgccattttcagctggagcgcccaattcccaaccctttggctgaagtggtggtccgatgctaatggtgaaaacaccaccatgtacatgaccgtgtacggtatgttctgcgtcatctgtctactagccctcgctctgggtgtctggacgctggccatggtaggaattcccaagtcgtccaacaaactccatgaagttgtacttcagacaatgatgtctgctccatactggttcttcgtgtcaacagactcaggtcaaactctcaaccgcttcagtcaggatatgtccctcatcgacatggcgcttccagtcgctctggtcgagttctcgttcgcggtattcctctgcataatgtcagctgtgcttattgccttgggctccaaatggaccgccctgatgtacccgcccatggccatcattctatatgtcttgcaaaagttctacctgcggacctctcgccagatgcgatacctcgacctcgaggcaaaatcgccgctatactctcacttcatggaaactcttcaggggctctcgacaatccgtgcgtttgggtggcaggagccctctcggatgcatcatcatcagattctcgacacctcccagcagccgttttacctcatgtacgccatccagcgatggctgaacctggtcctagatatcgttgtcgctgtcgtcgcgacgttcaccatggctttagccacgcagcttccaggggcatcgaactccggcctcggtgtgtcactcagcaacattctgtcctttagcggcacaatggcgcttctcgttagtgtctgggcagagctcgagacgtcgctcggtgctgtgtctcgtgtgagggcttttgagaagatgacgccgtctgaacatcttccagaagaggtcgtggagccgccccccgaatggcccaccaaaggcgagatcgtcttctccaatttcgccggctcctataagtacgctacacccttttttatttatccaaaggtcttcaaatgctaacgaaggagttctcgtagatccccgtcagaaaaggtgctaaaggatattgacttaaagatagaagcaggccagaagattgccatctgcggtcgcactggaaggtttggctccttgctccccagattcttgatacacagctgaccagtcacgcaaatagcgggaagtcatcttttattctgtccatcctccgacttgtcgagaaagttgaaggaaatatcatgcttgatgggcttcccctctcagacatccccagggcacgagtacgcaggggtgtcacgtccattccgcaagacccgctcatctatcgaggaaccgtacgcttcaacacagatccccattcaatccactcagatgaagatatcatctccgctctcaaggaggtgaatatctggggcgtcctcaacgagcggggcggtcttgatgcggacatggatactgttgggctgtcacggggcgagcaacagttgttctgcctcagccgggccatcttggccaagccgcgggtcctcattctcgatgaagttacgtcgagcgttgaccgcgcacaagaggataaaatagtcgaaatgctgtaccgcaactttgagggcacaactatattaatggtggtgcaccacttgcgaatggtgcgcaactttgacaagattttggtgcttagcgaaggtgaaatagtcgaatgggaacatccagacacgttgatgatggtgaacagcatgttccgacgcctactcttcacgcaagaggccgcggatgaggctgcggatgagaccgagtagcaacgttcggcgcagatgttgcaggtgggctagtttcagaatggggggatcattgaagtttcatattacatataatacaggcattagatttacatttagaacgatacagctaaaattgaagaacatagcaagccgatacctttgtagacaaataagggctgagcgcgctatatcattggtatcatgcttctcgtcttgctttttctatttcatataatgaccaaaaatccaacccagtgcctccaagtggtcgccagttgggagggatttgaagcgtgcccaaggaagaagccataaacatgatatagattttatcacatatctgagaaccacaacactcttctatgcatatctcttctatcaattgagtgctgaatgccccgagacgaacctatttatcaatttctaaccgatcacgacctctccctttcctcgcttcaagctttaccccaactatgcggcaattctgtgctggacaggggcaactttgtgagaaataccattaagtcctttggtgccattctcaaatgagcccgtgtaagaacgggcagcaagacgggccgccacaagagcctgctcggcgtgggcgacagcgccctgcagaatagccgccgtggggtcctgcgactggcgccctgcctgctgctcagcccggagttgaatgatgtggccattgagccagacaccgtcgagctgggcttcggtcatgtcgcgggcgccggaaatgcggcctcggcaggtgggagtgccgcagaggcagtcaaaaggctgggccatggaccattctgttgagggatagaagaactgggcgaggtcagtaaaatatctatgcatggagagtaaaagctactcacgctcagttcatcgccaggctttaagcccttagggccgaccaagacgttgaaatttcctacgtcaaagaactatggcaggggtttacacaacagttagcagaggtttaaaactagtagaatagccgagttgaacatgcgtaaattcgagagggtttgattgtatactgaccagagttggctcgcaagagtggttaatatagaggagatcgctgttgaggttcagatgggtgtcacgaccggtctggacagtagcgtaggtcggctctgatgcagtcgtgcaaggaggaaagtcgaatttggcaaatactgaaaaaggcggcagggccacacgggaaatgctcttggtagtgtactcggcagggttctcgacgacttcttggatatccggatgggacggacggtgccagtgtggaacaataggtgccatgtttagatatgaagttcgataagatacgaagcctaggaaggatatcggtcgatgtcgatcagagatttagaccagtaaagataccaaggtttggggatatataaaactcaagacggaacgtggctaacaccaaaccttcgttagatagtggcagagtggcagggaaaatacgttgcgttattgggataatccggcatcggcttccaatcgttatgaagattgagctcgagggaggtagcaatcaaccattgcggacgatcatgtaccgttttcacatagctaagtactaggctaactaccggtcatcaagaccgtaagcagaatcaacgattgattatgtgggcttcttgcttacagggcgtgtataatgtcatcgcatggtattgaaacgcatgacaataaattacttgagcactgaagcataatgagcaccggttgggcccatcaccacaaacgaatgagagcccatccattagagatcatcaaaacagcaatctctcattctatctccagcctcccattgcccccgtctcaaacaaatttttcaagttgtcagtgggccttggttcgcagcacccgttcgacagccatgtcgtctccggctgaagcatcccgcagcttgccattccaaacgaataagtttgtgatcacagcggcagtgatagttctagttggccttctcctaaactacctatcgacaccgaggactgaccctcgtgaacctcctcttgtgaagcctcgcatcccgcttattggacacttggttggactaatccggtatcaaaatgagtatttcaccagactcgggtatgtgaattcagcaaggcgcatttttattaaaagcaaagtgatcaaggctaaaaagtaaacagcaagagagccagcaagggaatctgttcagtgccccttttcggcagcataacatacgtcatgtgggattcgaatcttattcaatctgcctttcgcaacaaagacctttcgtttgtcccgttcatcgtctatgtaccccgggaagttgatcagggaggagtcccagaaaaggatcaagacaccaatctcaggctggagttcgccaaagccatgacggagggcatggcaagagaccgcatcagccaaatgaacgggactgctctcaagtatatcacaaaagagctgggcgcgtttggtggcgaggagtctgtcattgataacgcgtatgtctgggtccggaatctgatgaccgtagccacaaccgaggcgctgtacggatctgcgaacccgctgagggcacaacccagtctcgtttatgatctttggtaactatctggagtccatctccttttacccaactcttgttcgggggattaatatctgtcttctaggaggtttgatgaggatctacctacgctgcttctgggccttttcccatcctacacggcaccagagggactagaggccaggcacagactggagcatgcacttggggagtattatcacaacaaaaaagacgcgaacagcgatgtttccgccgtcacacatcaaagagccaacgtcatcagaaagtttgtgacgacggggaggacaatcggcgttcatgagcttgcgctgcttcatgtgtcaacctcaaacagtatcccaacactattttggttttttgcgcacattgtcacgaggccagctttagtcgagcgtatccgtgacgaattgatgcgcatggttggagatgatgctgggggcacggtcacgatcaacctcgatgtgctcacagaggagtgcccccttattgtgagctgctacagagaagccatccggataagcaatggtgcagtgagcagccgcgaggtgctggcggacacgacaattcaagatggtgagggccgctcatatctcctcaaggcaggaaatagcgtgcgaatcccccttgatcacctgcacaaggatacagaagcctggggccatgactttgcccagttctcaagcgacaggttcctgcaagccgatgccgccaaggccaagctcaggcggacctcgtatgcgccctttggcggaggaaagcacctctgcccaggccgcaattttgcgtttggcgaaaatctgggatttatggtgtccttcattctctcgtttgacgtggcgccgcaagacgggaactgggagacgtttatgcccccggcaatggacaaatgcacagcagccgatgctgtttgtaagccagcacacaacggggctggatttggaatccgcatcaagaggcgtgagggctgggagtcgataacttggaaatttacgtctggcggagttgatctgcttaacctgtagctggatggtagacattaagccaagagcagggattcggttctgacggcagttataggattcaatgcattggcatgaggttacatcgtcacgtcgcccaattccggtgcttacagttataccgtaaaatgtcactggtctggctcaagacaagccccagtcattccatcgcagctccaggtagaatcgagaatggcttcacgcaatgccccctgggagattcctggacagaaacattttatggggttgatttgctcaattcagttagactatacagccatgccctgcgatgacataccacgtgctaggtaccttgttaagcctaatttgaactgaggtgccctgtagttgtcatttggttgcctcccgcaaggtgaatggaatcaccattgtcttatgacctccaatgcgtcaacatcggatatgctccggcattcccttcaactacagaaatatatatttcaaataaatattgaggtagttattatcctatactaagattcataaacaaaggctctctacaaggatagagattgaggttggacgggagttgaagcaaggtatagggtaggcaatcattctgtggaccgattgataactttcgcgggattgataagttcccccgaggtctcagctgttattgaccagggttaagagcctgcctcgggttttgaccaatgtgtgtcggccccggctgttctataattacatagacactctaaagtctgaccactacctctgattaggtctggtacaaatttacccataaacaggggctatacggcgagaaagtggaggagtggaggagcctgtcagcgtgcaacatcagcagtgacgacaaggcctggcttgcaatgactcattacgcatgattcttttaagtaattagggctgcaaaagtactcaggcctctatcggcgaggtcggacacgggctttcacccgctccgttttcttctttggtttctctcccatgacaaaagcagcaaaattactgcgatcccggcacggtactaaccggagctaatcggccggggaaatatggcgggaagggaatggcaatatgccgtgtgtaaatgtccgccggaagtaccaccgtataatttcgcaaaattcgctgaaaaagggccccacattgcacccttgttcgtatccacaccaaatacacccttgctcgcttaccgggcatagctgcgtaattgcatagcggctaaaaccgagtaggatttaatcaatcaatcaatcaatcaatcaatcaatcaatcttagcctatataaaggagcccgaatcgtacagacgatgggatcccagacaaaactcatcagtactcttcctttcctatattctctcagccttccttagctttcccttcgtcagctctacttctctactttcaactcttctcttcgcttccttattctctctcgagcaattttcttttgccccgtgagacacgccagcccagcatggttcgcccacttatccaaggtttcgatggcgagtattaccagagcttcggtaaacatgccaactgtaccttagaagtctgtcctattgaggccaccatctacaagtacaacccttccaagcctgtcaacactgcactcgctgttatcttcggtctcatcatggtcggtcacatctacctcggcgtccgatggaagacctggggttacatggtcagcatgatccttggctgcctctttgagattgccggctatgcttgccgaatcgtcctgcacaagaaccctttcaagtttatacctttcgtcgttcagaccgttgccttgaccattgctcccatcttttataccgccggaatctacgtcactctttccgcaagcatttcccactttgcccctgctcctgtccaggaagcacaggaggtaggtaagcatgacggtgggcacaatatacttgtcgagcttccgcacgaggttcctctcggcctgatgatcaatcatcatgtcgtgagatccgttggtggctgaagctctgtcgtcatgttcagcttgtattttctcagtctccatggcgaatgctggagcgagtatctcagtcgaggtaaaatcggttgcggaattacaagacaaaatatcaaaggaaaggccgaaaccgatgctgataactcaaaaagatcgggagacggatctaccttgttcagcagatgagtgtcttcttttcaatcgaaccaagtctaggatcccggccgctttatgtcccaggcagacagacgcgtctcgacaccaacacgcttgtcggacccaatactctggtcaatgatggcatgcaggtgaccaatctccccagagtcgcagtcccagtctgcatcacaggcttccggcagaatcttctcagcagagattccctatctacccgaaccccgcaggaaaatttactagccccgtggggccccgcgatctctatcaatcagctcgctgaaatgaagtatgcgccatggttgtgcgtgcccgagtcatgaccgtgtccgacaccgggttcgtcggctcattcccgccggtcgacggctcgcagatgacccggtggcgggcatggcctttaaggcaaaatctggaatgtacggcattcttccttgacagccattctccacatctatcaggctgtgtatggtcttcttagatatcaaatacaccctcgattggaagtatagtcgaccgctagagacgacgttggacgcggtggttgctttatttagaacaggatagtaaattgcattaagagcaatgaccccttttcattgccgttgaactttttggctaggcaggcatcagcaactttcaatccagcatttttttttttacatcctctacatagctaaaagactccctttcccccgggctgacccgtggatgctcacaatgacctaatatttagagtaatctaggtctttaaatgaataaaaggctgagatgccgcaatacaataacgttagtcttaaacattgtatctagatagccatttatcgagctcaccatatatttaatctcgcagacttgcaatttttcaagccgtcaagtaccttgcacctattctaagtcaacgagatcttgacattattttacaagtagatacgttgtaggacaatacactgcggtgggttcgtttaaatgactatattctgtatatgtacatcgtctctcaagtgctcttccaaggaaaccatctaaagttttgcctgctcagacgactggaaccagtccatgtactttttctggagagtgccagtaaccccagtgtctacatgaaacggctctcgttccccgttcagataagtcgccagtgccgtctccgcgtgctcctcggcatcatatccatacacggagaggaccgtctgcgggtcgccatagaggttgctgctgcgcacatagtacttgccctgcggctctgccgacatggccttgtcgcgggcttgctgcgctgggccgtcgggcaggtgccagatggcgccattgatgaatgatacctgctgcttctcgtaggcctttggcatgcgctcctgctcgaagatgcggacagcctcatccagtcgaatccggccttcaacaaccttggcaatgcacctgctgaggaaagccccgtcctccatcgaagtagcggcgccttgcaccatatggttgaccatggagtgggcggcatccccaatgaggacggcatttttccgcctggacgaccatgatttcatgggaccggtgaccatcagtggccatcgagactagacacttggtatcaggatgctgtcaaacgtacagatttgggtggagggcctaccgtgctatcaaccatgtcgacgatcctcttgatgcgtggatcaaagtccttgtactcattgtgcatctcctcaatggggacgttgagctcagtgccccggaccttctccgggcggtgatgtgagaggaccaggttgaagacctttccggcactaatgggataagtgatgatgtacgcattctcggccatccacacctccatggtgagcttctcaatcagctccttggccacgggatccttgcggatctggtcataggggacaagagcgcggtaggcacagttcgtggtcgggggctcaggggcgacgttagggaagagagacctcctcgtgacgctgttgatgccgtctgccccgacgaggaagtcaaagctgtagctctggcctcgatgagtctcaaccgtgaccccctccatgctttcaaagtcgatttcggtgacggcagagttgatgtggatcttggcccccagcttctccgcgatggccaccagcccttcgtggagatgggcacggtggacaacccaccagggtctcccgagagactcctccagagtgtcaatcttggtgtgtcctacaagcgttccatccttgcggcgcatgttaagctcttcaaactggaccaggttgtcgccgataatcttgtccactccccagcgctgaagcagcaccgagacattcggggtcatctggatgcccgcgccaatctgtgaaacagtcagctgcccatcgtgctaaaattttaatcaaccagattacaaacctcgccaagctgctccgcggactccagtacggtcacctgagcccctgcccttcgcatggcaatggctgtggtcaggccgccaatgcctgcaccgacgatgccaacatgcagttcctttctctgagaagactgttgacgattggtaagcttgacggaacatccctctctacaagttgggtgggttcctgaccattttgattttgacgatgtgaatagtgcgtctaaaaacttctcttgaaccgtgaggatcttgatcgctggtttactccaaggacgagattgattcattgaaacatagacatgtccttatatccacagcgcgctgtaggcggccgtgatgttagaaaactgggacgagccgcaagactgaccattccggacggccttcggggagttagggatctggatctgcccagaacgcttcggtcgttgatcggttcccattctccgtggccaggtctagatgaagtcacttgatgcgtcgaggttggttctgccatatgtaggccgttcaggctccgatttcagcacttgttggaccatcatgccagaacacgtctctattttcacacctccggcccaaagcttcccagtctcttcagttcctccagttactttttctggtacccaagacactcaaaaacatgactacacccatcaaaacacttctagttcctcacttgggcggcattcatgtgggccatcgcgtttctgcgtctctcctggacccagcaaagccgaccctggtcctgttcaaccccttcaccaccacggcggattatttcttgcctcaattccaagacaaggctctcacagatgccctgaacctagtggctattgagcccctcggtcatggaaagacccagctcaagaagacggagtcgtttacctactgggactctgcaatcatgagcctgcagctccttgacatcctcggcattgacaaggtctttacgtcggggacttctcaaggtggatggatcgccacccgaatggctttgctggcacctgatagagtctgggcatctattttccagacagtcgagcgtgatgaggctaattagtccgtataggtgaagggtgtcatccccattggaagcagcatggactttgaatcgcctaggagccgagattaacttagaaactaattattttataattaaaatctaagaaaagaaatttaatattatatataacttagtactattagaaagctataatattatactagagctattataattataaaatataaatctactaattaattagtatactagctatatagagtaatagaattcttttaaatatatatttagtactattatatagtataaataactatatataaatagatatcagattaatattaaatctatattattcctaataaaaaccttctatagtagtaaatatatactatacttatagaggtgaattaactaataaccttatataactaacttttcttatttctgaataagtataattttagattaaactaaaataaactctgatatactaatactaaacccgatctaataagactaataccccgatctaaatataactaaaaataatataaagtttaaataattaatttttaagagctatctctactctgattaacttaatatagtatataatatactgaaactataaattatatattaggttatagtaggcctgtataagtaggtagctattcttaagatatagcttttcttctagctagtctctattctccataagtacctatagtagtactaggtaggctgtataataaaacaacagactaagcagatatagctactggatctataatattaaaagcagctttattactataagcaggcccttaactaactaaaggggtatataataaatataattagtaaatagctatattagatcacctcggataatagttattattactttaagggttttattagaagtattaactgggctctgagaggttagaatatttatattagatattatagctataagctttaagtaggaaaggaaaggtagttattactattagataataagcttcccctcttaggggctatagctatagccgggttatttatatatctagctatataaatagctcctattattagagtttttaagatattaatacctgtacccaggctgaaagtataatatttaactttatcttatagtattaaaggtttaggtatagactactaattatattcttaaaaaatatatattagattatatattatctgatcttaggatatacctttatttatagcgaaactaatagaaaatatatttagtactaattaattagaaataactaataaaagaataataataagaatataaagttaaatatagctaataataaaagaaaataaaaaagttatctctagaactatttaatattagaatctaagaataaaactaaataaataactaataaaagatataatagaataagaaaagtaatatctaatataaatatatataaataagatatttagaaaaagaaaactaactaaagaatattctaaaagaatatagaatttataataaactatttaaaaaaacttttaaaactagtttatttaaatataattaatagaattataaaatctttattattaaaaaagaaaaattacttttttataaactttataatcttatagaactctagttataaatactttataaatatattaataatatattaataaaagactatatataattattaactttatttataaaatatcctataatatttatactaaagaaaaataataaactctatttagttattaactattaatagctaaataagattatatataaaaatagaatattcttattattaattatagaatttagaaattagctatagaaaaaatagtaatttataatactagatttaaagagactttataatttaatataaattaaaaaagataataaatagaaaatagtatttaaaataaagtttaacttttataaatatcttataataccttttaaattaataaatatatctataatattttaataaataattaactaagtactttagaaatattttaatatctttatagttatttatcttaataatattttaatctttttaaataatctaaatatatatatatttttttaaaggtttttactatatataaagagtaatattctaagattaagctatatataatataatctatataattagtttttaactaagttctagtttatatctaacttttaactctatttttttttactttttattatatagctagctaagatataaataataataactctaaaaactctaaaaagagcttattaagtatataatttagctataggctctaaagggaaatacttattatttataattaattataatatctctctaagcttattattactaactacttcttataatagtaataatagatatctctaatataattattctctatagctagagtctagttattataagtaactagattcttatatatataataattatagtactataaacaagcttttctttaaaaggaagaattcaaccaggctatagttaaaataatcaagctattataattatataatctatcttataaatataggttttataataagtagctttaacctatataactatagaatacagttactaattagaagaatacctctatttataactataaaccttagctaaactgatatgacaaaagtttgcgaccacccccaccacaataccacccacctattcaaaccacgtaatttcaaacgtgcatttcacagctaaattagctttaattttaaaaagaactatattgctagatagcctgaatcttggcggttaatattttgtataccaaccccgtgcccggatgactgcgcacagccgatttggcagtaactcgagcaggccccgaatcttatgctgggggatatccctccacgtttgatcaacgcattcagcgaatattgctctatcacgtctattatccttaaggttacgaaggtgaggatatcgcttttgcaactgcctcttcagaaggctccaaacgttctcaattagacttaaatccggggagcaaggaggccactctaacagctcaatcttatgctcagccagctacaccattgagctctcagctgtataaattcgagcgttatcttgctggaatcttctggattcattataaattagaagaagaccttcctggagagctttttaatagctctaagcgctatagcctcggcgagatatatttggatcacgggttataggtacaagggatatccagccttctaaccagattcctccccaatacatctgagaaatcgtaggattattataatctattagattgacgaattcttgattatatttctcatgaggataccggaaaataaaaaggttggggttatctgatttattctgtattgaaacctcatccgagttaatcatctaggccggtcagtaacactataaccccttgatcttcaaaagcgcgtaccacaaccaattcttcgatatccgcaagccaagcttgtgcctaatgaagccgaattcgagcgtgttcagcagtaagtttcggccttttcattgctttccatttacgccggaaataccgttgaacgatgcgtctgattgtccggcttgagactccacttcccacttcattagttaaggtatcctatgtgatctcgcgatctttatagaccatacgaattatatatcgctcctctgccttcgtaagcaccttaggccgcccggatcttggcttataatcaacggtgccggttgcctcgaacctcttcttgagggctaggaccgtggtgtgtgtggtcttgaactcctttgcaacagcgcgtgcagacctacccgcagctaattaccccaacatagctccttttgcttcaggagaaaattggcagcctcgacggcgatttccggatatttcgacaccaaagcgacgcattttaatgaaaaattggctgtgttatggagggttgaagaggaggggttggtcgcgaccgtgtcggggctaaaacgcggtcgcgtcgggtggtcgcaaacttttggccactaactgtagtctattaatatataagtattatagagctagtaataatagatatatagataattatattaataattatttaaaagagtatttctatttagaaaataaatatatatatatactagagtaatatatataatatagaatatatctatagtaattagtaataatatagttaatatatagtatattaactatattatatttagtatataactagatataataactaagggggtatttaaataaatatataggaatagtttataatactattttatagctagcaagagtataaagatagattttatctttaataatatatttataaagaattataataatatttctttagtatttaataattattataatttaatatactatatatagtactaatagataatatattaatttaaattaatctagattaaaatagctttttaaattaaataaatatctattttaattagtattattaaatagaaaaaaaattaaataaaatagaattattaaaaagtttattaaatagaaaaattaaattaaataaagttaatttaatagtatttagaattataataaattaacccctatattattaaaaagaactaacgtgatccaccaccatgtgggccataccaccatgtgggccactttccttaattttttatatcttcttcttctaattagtataactcaacaacctaatacaatgacactaagtgaagaacatcaaattactcttgctcttcaggccttacaatctacaaaaacattaagcatccggaaggctgctaaaatctacaatatcagccggacaacactaagccgtcgaaagaagggtagaagcgaccgagacgcgtttgccatcaaaacacggaagcttacaatcttagaggaagacgttgttcttcagaggattcttgatctagattcccgatttgcaagggtcttgatgaacaacaagtgaagatatcactcaatacagtgaaaatcgcacaattagagaggcaaaatgagatgcttaggccgaaaaaacggactcgattgcttcctaacccgaatagcaagttctcaacagttgaacagctagccaaacaagcagcgcgatacgatgcgatcccggatgagatagaggcaccagaggaattagaaaattatatctttgaagagctctgcttccagtggcaaattgaatagcttctcttattaaaatctattgaattgacgttgttgtgttgatttttgaatctatcgcgattttcatctgggtgttccgttgaggggggtgttccgttgaccagggttacaacttactcttccatgcaaagttttgatgcgggaacttcattatcgcttgctgtacgactcttattatcgacgccgtgccatggatcggcatctcgagagctcgaatcccggcttgcctctggagcaccagaccaagaaacgactgcctccaatttttcactggaacaccaaaatcttcaccgcggttttccagaaagacctgattctagctgtagtattcgagctgaagcatcataatatctggcctctgatgcattccctagtcatctggcagccttgcatatgccaccatttgatcgtcacgccaggaccaggcacctccgaccacctatttgttcccataaggctgggagccaaagaacttttggacctttcacgtgacccgtcgcattcaatcgatggctcatgccgaagttgcctaacagattacactatcaagatggagagacgggcgcctacgacattcaaacgagctcagtattccttgctgattcaggtctggagtaacctcggtcgggatgccactctggatccgttggggatatcaaataaactcaacacgcgcaatttcgaagcgcatcctgtgggctccgtacgtcgggattatctttctgttgcggggggggaatgtatgagaggtagcaaatagagtcagattatgtgtgtatctcttatcagagttcacaccatcgtgagggaaaatctcgcattggctgaaaatacagttttgctgggctggcctaggctttgatgggtgtatggaagggacattaaactcaacttaaatgcagcttcaaaccctgctgtgactggggataagactggcaaggaaggcaagaccgacaatccccagttttggtctgggtgggctttgtaaccagaacttgataacagcgaggctagcttacacgaaagtgctaggctttctaggataaatgttggctaatggaaactgagttctcagtcctcgcgtttaggacagatgaggcatggtgtaccacacttttctctccgcattctgttcccgtgacaagccggtctgcacttgtagtagtgatggtcggccgggttctcgagcggcatccggcggcatgactggaactattgttatctgtggaggaagctttggggttggggggccgaaacgctcgtgccattatttaggccatcttatgattcttatccatggctccaagaagcccaaaccatgcgccccagagtgggggtggctcagagaaggaagttagcacgaggacagaagagaagacatgagataccagacaccgcgctctacagccccattctcactgacattgcgtacccttccaaaaggtcttccatgattgcatgctatctacatcgagagtgctattcaaactgataataattaagatttccattcaaattagcattggaattgcttggatggccaatctcggaagaggagccgtctatcgctggcgtgcgagtcgcgcaatctcagaggtggcagatcccagataagcccgtgataagaaccggccccttaactgaaaagccggtgtgctcagaacggtacgtaatggcgacacctccaccggcttccagcgtgtggctgctggaagatagcctaagacagccttagatagggcaatcttgcgggggaccccggtccgcccagcgctggttagcgtctgttggccactgaagtgctgccgatattgcacgattatggcgggggaagataacgaaccccattgaggcaactggatccggtcgggaagggtctcttgattcctcccagattcgtccagatggtgtggtgtcattgattgcttgattgatatcatgccgtcccccagaatgatctcccgtcttgcatttgatttggatcctcttcttccctgtaatcctatcctcccacactcgtccagcacccagagtcccacacaatgactgccatcggcatcagaaagagaagcccctctgcctgcagagaatacacacgacggcgtgaccagcccatccctatgagggccgattaccacaagcaaggccaggctgctacccgacaaactgactggcagcaccgagagccgtgggccagacaacatgaagagtacaggcatgccccagcctccaacaagcctcgctgggaatgtgcaaaggcaaatgaaaagtctcacatgcggtattctatggagcgagccagtcacctcatggtcaatgaccccgaggagaaccatcttcccttcccaattctcgaatatgtccgacgctggctcagtttcaagcacaccccccatagctttggcgccagtcatcgaacttatttgtatcccgaatcgcccgccgggttcttggtcaatagtgtctctgcctcgaatcaggaactgttcccccgattcgtaagcgtcatgcttgcaggtctttctactgcgtggacgaaccctccaaatgccgagttcgaccagcagcatctccaggatgcacgtgacttggtcgatatcatgctttccgagtccaagggccgagatacacgaccgccatacttcaacttcgtcgtaggagcttttgtgtactgggacatggctacatcattccttgttcctgtcaaccagcagctgcctctcaataccagtgaaatgtatgccgccgtgctcgacgtgggccaagaatatcaccctattgcgggctatacaacagacattttttatcttctgggcactgtagggcgctactgccgatcggtcgtcgagacaggagttcgtgatgaatcccttgaggccgtgttggaagaagagttggagaactgggaaccgaatctggaaaatcccgagttgggactcatgagcaatgcctttcgcatgcatgggctgattagcctcgctggcatttgctacaggcgacagaatgtaaacacgccacaggaacatcgcgacctgtccgtcataatgggcacggaggtgcaagaacagatcgaggagtggcagaacccgaaaactcctcctgccggcgacaatattaccgaccagggacagggccccgaacatgaggatgatactgaacctgatgaatttcttgaagcaatggtcaggatgcgtgctctgagcgttgttcgagatttggcttcaataccaactgacaatgcttgcatcaatctccaagcgatcccgctctttactgcagggtccgaactaactagatctgaccaaaaggagaggcaaatcgtcattcgacgattcagagagctgtatttaatgaatcatctgcgtacgaatttatcggcgttggagatcctcccggagatctgggcccggaaagaccgaggcgaaagtaccagctggttagatgttatggttgaaaagggttggagcatgatgctcggttaacctactggtcctctacttctgtatttgtttttcctttttcgaatacgtgtatgcatatgagccggagtttcgttgttgcatttagggagttcaagggttgtattcttttatttatctcaaaagagcatcgagagggaaaaccattaaatgcttagtcgtacatgataacaatctgaaaaatgatttgagactatttccggtataaatatccgctaatgtgaaatgtctctcaagtctaaggcgaatatcgtgacatactttgtacaatgaagctattttctgttgggcaaggtgaagaccaaccagagcttaagggtgattgaccagctactctatcctccgaatcccccaaagacagatggtcctccaaacatatacctggacggttttgcaggggctggagtattcaccggcgagggagatgttgccatcgaaacatcaatggatctgggactgtaaaagcttgaggatgacggtggtgcctgggacgcctgatcgccatttggttctgcgcctggctgctggagatttagggagagcggaactctgggctgagggtgggatgggaaagcttatcaggcttcgagtcagcaaccagtgatacgattgttgtggagagacaaacctgttacgcctctgggctgatacttctggcagatagctagccctcttctcaggacatccacgtcctcttttaaatgcttcctgcggtcctgcacatcctctgactccgaggtcagctctcggagtcgatgctcaggcatgatggaaacctcggtgggtgtgagaatcgaaggcatgtcggcaatcaggcagctttcaatagcgaggttaatcacgttgactgcaaatgttcgtcgcgcggtctgtagatctagatcaatattgggcgtaagagaggggagagggggcaagaaagagaggtacctcgtagtacgctcgcatcatgtcgatgacagtctgcgcaccatactcgccgtctttggtctcgttatcgtctgatacggcagccgatatcatcgatctggtgagcttctctccggcgcttttgtctttgagcaagttgtaaatccggttagtcgttctctcattcgacttgaaagaaaaggccgagtggaactcggcatcgagtgcgaccgagtacccattggcgtacggcttcaagagctcctgaagcttggttttcagaatcttctccttcgcatggaagaaaggatcaacacacgtggacagaatgatttcggtcgttctgttagagtcaggtggcccagcaagatgtgtgaagattgcatcgacgaatgcttttgcaacaagagtgacacggtcaacatggaactgggcgattggctcccagggcttcgcttgctcctgaaacaagcggatcgcaaggtctttgttgggctgcccaggaaattctgttccttggttcattgaggcctgttgttgcagctctctcaaaacctcggactcttttctgacgacaggatcagggaatctgtaagggtatttcctcaggaacaattttaagctctcagacgctggctcctccgttgctgctttgttagataacgaagctgaaggaacgatgtttatcgtggatccctttgtatttagaacatgatcaaaggcgcggttgaaattcctgagcaaagcccggaactttagatctccatccctcagaccaccaaagaaagcatcatcgtatcggccttgaatcccatcacgggtaaggcgctggaattcgctggcgattttaatgagatacgctctcatctcatccaagtttgacctggggttccccaattgggcgagttcactctcccgttccaccatgttgctctcgatgtcacggataacccgagggagattctttcgaatgtgatcatacgagactctactcaaccgcttacgcagattcgagatgccaagattctgttttggaactgaagcccattccgggtttttgaaaaacctgtcctcgatatcgtctcgggcgttgacatccttctcaagctcggtcctattccgtacggcatgccaaccgagttctagcttgttcgcgccttccaggttgctagccaactttacgtatgccgcttctctggccgtgccgggaagagcaaggtctggcttcgtaatcacgccaatggttcttgagccatcagggtcaactgccctgactcggtcgagagcgccgtgtcttgagagatcaagatcagctgtgatgacggcgagaatgatgctgtgtggctgcttcatgtactcagacacaatggcattgacagtttccttgtcgctcagcgtctgtgattccgcaacgttctcaaaaagaccaggcaggtcgatcaacgtcagaggataaaggttgggtccttcaatctcaagacgaagaacatctttggagaatccagtcccggagagttccatgtacccctgcgagtcctggataatactgggcagatcctcctccctgaacccggatgtctggaaatgttggggcggtttgttcttgtccgccggtagcaccgtggccctgactctaccttccagcgacggacgaagcaccagctcagttgcgaaccgtgtgcagaggccgtccttgattgggaagcggatgcggcatagagcctcgagcacagaagacttgccggacgactgccctccgacgacaatgatctggggcagattgacgatccggccgacgccgcaggcgccgagctcgttcatggcctcatggagctcgctggcctcgcgagtgttgaactcgctgaggacttgtgagctgactgatatctccgccgaacgcatgatgcctttgtgtcacaagagcgctcaggtgaaccacagggccgcgttatatctggtctcgagcgttcgcgccgcctgttttgtgtggagatgccgcagactgccagagtggccatctcagcaccaaagaggatgatgacaggggattctacagtttgaaacaaaagcacaggggtctggcgaaacggtgcaattgtaggccccatcaagtggccctaaaattagaagcaaccaccgctgtagagtacgagatatgtgagcttacgtgagtgcaaaatgcaagattaccacggtatgtcaactttggtgccctttgctgcatcatattttttaatttccaagttaaatatttgttgccggctcgaatgagttcaaatgccctcataaacgaggccttttgtgactcattccccgggctgtgatcaaaccctgatcacacttggctgtgttaaccagtgtaacttagcaaagaggtggaaaactacgtatgtaaagcaagaaaatgcaatgcgccaaagatgaagccggaatgagaagagagcgtgaggagagagaaaaaaaaagaacggattggaatcaaaaggccaacatatgggccaaacaacgaccgagaaaagcacatcattaatgaggctgacttatagtgtcatggcttctataaaccggagcgtgctatattggacgctaagaaccttgggcttcctagagttgaggcacgtgaggcaacatatgtggaagctgctctccggcaatcccgagtggagggctgcctatctagatcgcgctgagcagcttgtggagagattcaagaactcaaccttctcaataatttggtctatgggcaatgaggcattctacggagagaatattgcatctatggcccagtgggttaaggagcgggaccctacgagactggtccattacgaagctgacctcgaagcgaaagataccgacatgtatagtcgcatgtattatactattgacgagctgaaagaacacatcgccaatagatatgaccgcccactgattctctgcgaatatgcccatgccatgggtaacgggccaggtggtttaaaagactacattgacgcttatcgaagcgaaaagtctctacagggcgggtttatctggcaatgggccagccacggtctgctgcaaaggtctagcggtggacagccattctatgcttatggcaacgattttaagcaggcgctgaatgacagtgactttgtcatggatggcatgctatggtctgaccatgagcggcctagccctggattactcgaatacaagaaggttattgaaccggtgacggtggataacctcgacctcgcagccggaaccgtctcgattcgaaaccatctattcttctcggacttggcccatcttgaggcttcggtcaacgtcacagtgcaagaccagaagccgacatcttcggtagcaatgactttgccacccattgggccatcctcaagttgcgaggtggatattccggaggagatcctggctcttctccgagagcgttccgaaaagaacaagtggctgaatctgttatttttcctccattcagaagttccatgggcccctcgaggttatgaggtcgcctgggctcaaattaagactcccgctcgccttacagtcagtccggcggtgacaccaaacatcacctcagacgacgaaagcagcatcaaggcagaggtcaaagaagcccgtgggcgactcgtcatctcaaccccaggtcataactccagcatcatttttgacctcgctcgcggcgggttccgctgggccggcgaggccagtgtcacaattacgcgcggccccgagctcagcatttattgtggcatgacacaaaacgatgtgggctttggaggagacggtgctgaatggaagcgatgtctgctgcacatagcacgatcctgggtcacgaagcacagctggacctcgaacgaagatgccatctcggtagtaagtgaagtgcgggtcggtccaccatcattgacctgggcgatcagagcgaagctcgaatacaccatctcccactcccttcagagtgtatcggtctgggttacaggtgacattgagaagcgtaaaggttcttccccgtggcctacaacagttccccgcattgggctcgacatggcgctacctaggtcgtataataccgtcaactggtttggccgaggccctggcgaatgttaccgtgataagaaggaggcacagcgtcttggactatacgaatcaagggtccaagacttgcatgttccatacgaggtcccccaggaaaacggtgggcgctgcgacgtggactggctcaagttgcaggttacgggtggttcggttgtcagccctgcgcttgagattcggatggctcaaggaccgtttagcttcgtagccaggcaccacacaacacaagagctggaagagaagacacaccctcatcttttgcaggaatgtgacgatacattactctacgtagaccatgtccaccatggtcttgggtctggttcatgcggaccgccgccattcccacatgaccggggttatgataagagctgagggagttgtgaaagtggaagatgaatactagagttattggtatagaactctgtaagtgcagcagcgctcttgtcttttatagttaaatcaattagtaataatatgaaagaagaatgattgctgacagaagccaagatacctatagagatgcggaaatcccaagttcttgagacatttgttccaccttagctcacctagtccttcctgcttatggatctttcgagagtaaagtcttggatgatatcatgtttgtaaaaccactttttcgttcaattgagttgggaagcggtggttagcctgccatgcgtgttgaagctacattgtacaaggggtttcaacaagctggattcaatgaggtagttcgaacagtttgaatagtatcccgataataaaccgatgacccgaaatccaatgacatttctgttgttgtcctgatgttctgttctttcatcatatagtctctcgccccaaggcctaaggcttactgtccaatgtaagcttacctgagacaaagtaaccaacatgacatacgtgggaggggcacgtgatcgccacttgtatcagtagctggctgctcgctgcaacgcgttcgcatgccgtgctctgctaaacagttggcgaaaaaggccaccatagaattgagtttggaatgacgcgtaagtactcacaggcgatcaaggatggcattcctacaccaagtagatcaccaacccagattggagtagatgtggattggggccgccaggaggctacgacagaacacgagtgatctacaattgccaagccagtatccctgttgtttcagtaagatggtgatgtcaagaaataccttaacgtaaaaaagaaggaagtgaattcccgcccaaaaattgcctaccggggacgctccgggtatgcaaacgaaagctgcttctcaccctttctacagtggcactggttaaatttaaggcaattcttctcataggagtttctggcgttgactgtactactctctactacaaatttgccgtcgtcccaaacattcttatgcgacttcagtcaccagtacaaagaaatacatagaataatctcattgtgcaaggtattgtttcactatgatattctagctatcagtcttgaatcatctagcatcagacttctctggccccgctggactattggatgctcgtccgatatgtgcatggctgaattaaactatggtaatggaggccaatgtacgccacgctgccgttaccggttccaaaaccagggcagccttactctacctgatcaatatatttctctacgaatgggcggtcccatttacgtacacgcgtggtgtttgataaaaatttgacacgattggtgagacctttcactctaggcgtatcagctaatcgtgaagacaaaaccttgtgtttggtaaccaagataggtggagggtggtctttcttccgtggagtttgtccgcatgtggaagatagtcccccagaaaaaaaacaaagaatatgggctacaatattgtttgtatgcggaagagagttctagtataaagttaaacaacaatggaagatgcctgacccggcctctctattggcgcaatgtacgcggaatgcctcatcgggtgttagccgtgatagtttgcctgttgggtcgtaactcgttgttttcagctgggcatatagccaatgaaattagttgagacagcgttgtgcatgggtataagaatttaacagcgcccgagtgactggttactgttccctagagggcggtttaacgaacagctggatgaccaatgacacaccgttacttccacaaggagtacgttttccatgtcagccaagaaaactgaagctgctcagctggtttaatgaacagaactaactgattttggataacaacccacctaatcgcggacaagattcaacatccacccgattgttcgataccctcttcggttattagcctgcgtttgggctacagctgggcattgaaatctgtattggcttcgatgagtcgttggcgagaaagtaacaaaagggggtgtagggatggagcgatgcagaaatatttaaattgagggatactcactgctgtatgcctgcacttgcacgtcattatttctcacttttcttcgataaaatcagcattttgcattcgttggacatatcaaaatccttcgcatcgatttgtttctagaagatgaaactcagtcgggtctttttagggcaaaaacaactccaactccctcgcccacgccagttgaagattgtaaatatccctctcaagaagcataatatatgccttcaggtacaacgatcaatttcctgtagtataccctatgttctaccactaacaaatattagctacaagtccctaatgttgatctatatcctgaaaggtccgagcgcatggttctcaactcaacccacctcaaatcagccaatgtctcagcagtgcaaaaggctcatctggaactcaaagtggccatgtatccagcttatacatcatgccagacctttgaggaacagagcagagttgaggtcggtgtcattgagagatttttccctggttacctagctgatggcgtgcgaatctgcttcgcagcatggctcgcctttatctgcgccgtggacgacatcttggagtgccttagcccttctgatggagaggctgttctgtatcgctgtattggaatgttgagaaacaatcacaaaatcaacaccaagggtaagaatcgcaaaattgaacatgcaaggcggttgcacgactagacaccgtactgacatcagttcatcgaacaggaagggcccccgacactgaggttgaaaggctaacccggctcttatatgatcatagcaggcttcatcttccggcaggtgtctgtgatgtatttttcaaggcaatatgcgaagttttaaaagctcatatcgccgagtttcacttcctggatggccagactacccacgatctgtctacatacatgtccatccgaagacgcaccatcgcacttgaccctttctttgagataatcaaatatatgcatcttccaaagagctggcgtcgaaagcctacatggaacaagctccaagaagaggtttgcagcaccgcaggactgcaaaatgatctcctcgggctggaaaaagatattgagaacggcgacggactcaactctgtccttgtacttctacggaacgagggggtgggcaacgcttacgaccgtgaccctgaaatgtttgcaaagtgtatttctctggtcatcaagatgcacaatgagagtgccttaagggtgttagattacatggaggaactcttacaaccagctgatgaagttctgccaacttcggtagtggaggttgcgaggcatcttatgttggtctgtgagacacacctggcatggtgtgcctctgcaaaaaggtacatgccaaaatcagagtaataggcatcatgttatttcaaattatatttgaggcccgagagaagcgccatttcagttctaccaatcaatgactgctatggcctgtcagtgatattgtgaatgactgtaaactctaacacgatgaacgcagcatagccagccagcattgcgcctccaatccagcggtcgaatctgccgccaaaccagacggttaacgtgaaagccagagttgagccccacaacactgcaagttctgtaatgttgacattgctgccatcgaattccccagaggtgtccagcatgataattcccatacagagggagagaagaaagatattgcttccaacggtattggccacgagaataccgatttgtcctcggtggccgcttataacggctacgaatttctcgggaagtgtggtggcaacggagaggataatgacaccaaacaggacgtcagaaatgccaataccgtccgcaatgttcgtcgcggcgtgggccaagacatagccagctaggcagatggataagaagccaaggactaagtaggaaatatggtatcccaaactacgccggtggaggctgtgctgctgtgactgaggtcctgtcgctgagttaccatcatggttcagcagcgcatcagtctcccgactctctgacccttcttcatcgatggatgtcctcgctgaatccgtgttgccgtcgtcatcactgttgtcgtcatccgagtcttctggagcaataaggctgcccttgctgatggcccagcttatcgagataacatagacagtgaaagcggctatcaaaatggcaccacatgccagccagatcgtcctgcggtggaaatatgtgacgggcgtaacaaagctggtgataactagtaagatgagagagtatattcgagagctcctatcgaactcagctggcctccccctctcaccgaataggaggccaagcgagaaggcacctaggatattcgagatggcggacccgataacattgcccactgccaatgaggaccgcccctgggcaagagaggagataacgacgatgagctatagccaatatcatgatcaacaaggaagcagaagcaattttgggcccgttgaaactcacctcttcccattccgcgccagccgtaagaagcgctattatcgtgccggggattctggtgcgtcgtgcgacaatggcggtatggtcgacgaacttatctgcgccaaactcgaggaggaacaaagtgctcacgaacgttgctatgttgtaggcaatggcgtcaccgttagccatgacggagtgttggggagtggaaatgcttggggtaggcgttgtgtatgaagttagttcaacaactcaattgctgatggagacagagttatggataatctgcggcactacattattccccccaattgcagataaatgataaatacccgtggaccactaacctctttccattcttttctgttacgcccgccactgttaagttggcaatgtagaacgtgtgaaataattttgggttatagggtatgcgccgaagctgatatgtacctacatcacacatgtgccgattggcatcacaagtgactttagaatagcattgctactgcaaataggattttttacgcacggaaaattcgaatttggaaactaatttaggcgacaaaacaaaggggaaatggctatagtcagcttcgttgctcgagccccgttcccataaaccgcgactggtttgcctctcccgtgtgtcaattcgtccaggttgacaagtgttgattggagaagactctttgcctcgacaatcatctttctacataagcgtatacattaggtgtagtctgataagcgggaaaagagtagaaaattgcttgcagcttttcagcaactgcatgagatcaggaggaaagtcaaaagcccgatggcttcatgcaatagttgtgtattggagcgtgtggggaagcttttgaagaataaatgcgcattatcattcatggcagatgagaaagtctagaacgacaaagatacgccgaactattgtaataatacacactttggcctacatacacaaaagcttacttcaacaggtttgctcggataatcggtgccgttaatgctccgtagtgcctacacgagcgtagtgttcagctttgaccgttatttttcatatgcaatgttacggccgtagatcatacccgaaaagaaaacacccgaaaatgccccatccctgatcccacatacatgcggaaaaagaccgaaaattctccattcatagcattcccgacactaccaaagagtcctccgtaaaattctgaggccgtcagcgattgaagaaactgaaaaatcaccgctgttcggcgattttctctccttatgcctctatggataacccggtccagttcaacgctaaaccctccgaagccgacaaaccgcgaataccaagagcatgcgatctttgccgccgtagaaaggtcaaggtatggagattcgttactggccagccacgtttcattattgactcacgctccttagtgccgttgggcggctcatgatgatgccacttgcgtgagctgctcgtccatgggagctcgttgtacatgggatattaaaccgcagaaaagaggaaggcctaatcggtacctaatagccctttctcgaagcctgagtccacgcttggaaattaaccactctcgattagctatgctcctgctagtccagttaccgatggccgtgacgcaaatggcttgccgcagtctccccacgggacgattgtaggacaagtcctgcgcgaccagggtccatcatccgaagaactacaaggggttaagatccaaagcgagtcactcctctcacagctaggatctccctcgtccgtacagcaagctcttgatgattggttcgagttcttctaccctattcaaccgctactgcaccgaaggtacttcatatcacggtatcaaggaggagagatgcaaacaaacccggaattcttggcattagtgatttcgatgtgtgctgctattgttgtcaccctgccccggaaagctgctgcggagtatagcgggattacagtctcgaagagcctccatctagtccggtactacaatctgttacagcctaccactggatgtagtgtgggctggtgcgtggcgtattatttgctggcttgggcccagatgggcgagcatggtttcaccgggtttgacgtctttaacaacctcaaaagtgccatgtcaggagttcagtggcttttgtctttccagcccagacagagcagttttcacgacgaagaaatattgaagcgcctttattggcaactgacaatcttggatatgttggtaatccatttacttcttgtcaatttcagctttccttggctaatcataaccttgcagagggctagatacgaaagggtggccgggctgttctttttaccctctaagcggtgaccagtcccgactaagaccccgatgtttatctgacgatgatctatctcccgcagaaggcctgatcccaggcataggcgcaagccatgatgatgctatagattacgtgactggcttcaacgctcacgcagacatcatcctaacgtggtggcacgcaaaagcagatagcgagcataggagcccacgcgaagtcattgatcgcggccttgaacgtctacaaagcatattagatggtctccctcccgagctcaggtggaggggtggcttatcgcgagacctgagagcaacacgcggacatgaaatgcaaatgctcaacatcatgattagttttctttacatcaagtccaaccttttggagatttatggaccagtagcagaaccaccatttacccattatacaatcattaggcaagtacaattcactatgcaaagcatgtccagagttcctactgactagtcttcttgctcagtgatgttctcgagattctccaccatgtcccccggaccatcttggagtcggtagggttctcggtagtcaagaggatcagagacatgggtgcgccttacctcgaagaattaaaattaatgtccgacgcggatgctttagcgtcagagtcaacaagacagcgattatggcaacttcttagcgagcttgagttattggattatcaaggagcttcaggaattggtactcattgctagaaactcaatccaagtcgttgatagagcaaaataacaataacagtgccccatctcagatgacgaagctccatggcacctaaacttttacgggcaaaggccaagcctcctatcatatttatatatttatgcagactgaaattcatagtattaggccgtcgaaacagaaggataagtcagccaactgaggcattcgaattacaacttggtgcgatctacttgtcggagcaccggaagttactggcccccgacagacgacgtggtccatctggggtattttcggcgaatatcgatgcacaagagtgacatgcttgccgtacggctcggccctaacttgatgcaagtctttggtgcatcggtcgtaatccaacccaaatgggccatttgcgtcattctttcagggaactagtgtaatgatagcaatgcgagagttgcattgcagatcaatgcactgcgtattgatgagaccttcgtcttgtgggttcttcacttccagtttcatctggggagcgtccgcttgtaaggtagcaatcaaattgttcgagtcatcccggaaagatcgggctcatcatctatgccgagatcccttggaaaaggggctgtaacatctatataagttctttcggttgttgcttcaacgcccaagacttaaggcattgacccaaagtagaaaaatagttggccacaaactgaaatctttacacctcagtatacggtcaaagcaaaaatgactctttcaaattcctcggcgcatcatcttccggcaagtagtgccttgatatcgtctcttgacctcccgactttgtcattcttcttggcaaccgctgtcttcgttgtcctgttcagccgtgttcgccggtcccgagatactattcctatcctcaatccgaagaagaaatttgagcttacagctcacagagtcaagaagctgttcctcaccaatggaaatgcaatggtggattcgtggttcaatgcgaatcctcacaagcccgcgcgcctccatgccgattttggcgaagtcacaattcttccacccaatctaaccaatgagatccgaaacgacgaaaggttcaacttctcgaaatggacgctcaatgtaagtcgcagcactctctttcgaaacatgactgacgaaagtgtaggcgtttcatggtcacacacccggcttcgaaggcttccgtgagggcggtcacgattcgcgcatactgcaaaacgtcatcattaaagacattaccaagtctctcagtatgtctcggtaattgatgagtacctaggctaaatgctaattgataatagaccagattacggaaccgcttgccgaggagaccgctctggcagtctcagacgtgctcccatctgataaaggtaaaacgttccattctccaagtttagaccagctgcttactatatctctctaaaagagtggcataccattcccattagaagcacaatcgcacatatcgtcgcgcgagtctcatcccgtgtgttcttgggtacggaaatctgtcgcaacaagagatggctcgaaatcaccctgcgctacaccgtcgatgctttcatggctgccggaaacctccggttgtggccggcgcctcttcgtcccctagtgcactggttcatgccaagttgccagaaattgcgcagcgaggttgctgaggcaaaagagatcatcacacccgtccttgaggatcgccgtctgaagaagaaacaagcgcagcagggtcaagtcaaatatgaggcaccagatgatgctattgaatgggtcgagagagcagcaaacggggagtcatatgatccggtgtcgattcaactgatcctgtctgttgctgcaatccacacaacctcagatctggtcactcaagtgatgatcaggctggcccagaatcccgaaatcttggagcctctaaggaatgagattcagaccactctgaagcaggatggctggcgcaagacgtcactgtacaatatgaaactgctggacagtgtgatcaaggaaagccagcgcataaagccgattggaaacggtatgttcaaatctctcttcaagttttcccccgactcatgagatgatagttgttatgcgccgcgtggcatccgaagacgtcacactcagtgacggtacccgtgtctcaaaagacagcaccatcgctgtcacatctcggaggctgtgggataagaccatctacgcggagcctgacaaatgggatggctaccggttctacaacatgcgatctgaccccgacaagcaagcaagcgctcagctcgttgctacgtcggacaagttcctcgcatgggggcacggcaaacacgcttgtccaggtcgtttctttgcttcaaatgaggtcaagattattcttatccatctccttatgaattatgactgggagttgcccgagggagcttcaacagctattcataacgtgggcctcgcaatgacgatggatccagcactggagttgaggatcaaggagcgggaggttccgatcgagatttgagcgtcaagatctagcatgcaaattgtagattgagtcttggatgaggaaggcgctctgtcacgtattgcttacagcgcgacgcaggaaaaataaaaaaagaggtaaatgtgtgtctattttagcattgtcggttgtgaatatattgagccaaacagacaaaggcaaacaaagggttaaaaaaggattgagtctattccatactacgcctatgatttagttaccttgatatagtattactccttttgctgagtatcgcggatttttttctaacccttgagcagtataaggagcatttctatgtagttgaatattatataaatctctttggtagcaagcttgccactgccctgtccgaaccgggcagcacttccttcgtcagtactcgggttgcatattaggtagagcctggggttagctgttctgcttacatgcatattaaggcgtctgcctccccgataatatctcaccgacgttgctgcctaaaagtggtcttcagtgccttggcacaagattgaaggttagaatcattattgcattgtacttccacagacaacccaacgatatcgcacaggctttcgtcaaaatgactactattctcagtttacccgatgaggttctggcccctatactgaacgcctctgtagcccacgattgtgcctatcgtgcagcgttactggcccttgtttgtcggcgtttccatcgtattattacaccgcttctttatcgcgacatccatataaaatgcaatggtgcatgcgaggcacatcgagatgctcctggtaccaagctgcttcatgacacgtttcgctcaaatcaatcattgcggcaacattgtcacagtcttgccgttgagtttaggtcggatcactcggactcaacggaacttcttgatggggaacgcactgcgccgaatgtgccccatatggctgtggactttctcaagtggctctctaacactgcagagcttcgcatcaggtttgtgtcattttatggcgacgacaagtgggacgagactttcaggacgtcaacgccatcggatctggccgtgttctataatcaggcctcaaagtccctaacgcgtctcaagcttctccagatatctggacatgaaaatgtgcctttgcacttgcctgctctatttacaagtctcgagtgtttggatagtagcgcaagtctacgaactctggacctcactggcgtgtcccaaattgggactgaacaagattggaagctaatgagggtgagaatgaactatgtctcttttctatcagatgatgaagctacaatcagtttttgtgagcgaaggctaataatcttcttggtccaggcccgggcgggtactgctccattcacagagctcaagttgcgccatttcacccaaggcgcatctgcactcgaagcccttgtgatgtggccggccgggttggaagcgtttcacttctcgatgccaatgtctgactactacagtggtgacttcgcattaacgagatacgacttgggtataatgaagacgatactatcgcatcaaaaagcctcgctaagccatatcaacatacacgagctcctaagccagccgggtgtgctgggctttgatctttctgggtttcatcgattgcacacgctgtgtatgtcacgcgatttaacaggtgttgatacccttgctgtggccaatcttgttgcgccaaacctgcggacatttcgttgggatacgggactcgaagatcaacagtgttgtagaggtctggaggggtttgcagaaactgaggaggactggattagagcatttgctgaatcttctgtggagcgcaagacttttctccagcagatccagatcagcttctccccagacagctggtttcttggagacattgataaggactatcagtatccatgggatcgaatggacagacttgctgaggaatttaagcctcacggtattaatgtggtatataactcccctaataccactaaagaggaattcttgaggatcaaggaagaatgtttgaaatttagagcttccctaggagatattatttggtaacggcgctgtgttttcatacgacctttagaaagcacgaaattgagaggcgagctttaaatggcgagtagaaaatgattccaggctttcagcagttcagagtaaataagacttctatagaaatatcccatgctgattaatggttgacccatttgtcgtttctgtcttagaaacagatttatgatcctacaagcgagacaatacgtcattggctattagcatacctagaaggaagtacgcgctgatcgcaaacggaaggcaattgaagccactcctcttatatttagccaaggatgaattatcatttgacgagatacggcaagagggtttttcttagtctttcccttgggatgaagtccatgatatcgagggtaggtgccccaacatcgccgaagactcgggtttaagagaactttgcttaggcggccaaaagtagtctagaagcaaatgcgcataatgatgtgaaagttgaaggaaattagaacacagttaagatttgcaaagttcagcgggagcttccttgtatggtggacagacattggagtgagtatggaaaattcgagcaatacctggccatcttgaatatccactgagccataacgctttggcttcatgttcactttcatgaaatttctgcttgtacatgccgttttagggagttatctttaaagagtttaggtgcgaaatcttgcaatcagggtgtaccctgttcattagctagtttacacattcataagtaatcagcggatggatgatttgggtaattcccgttggacctacacttgatccttcagcttaataatgctgtagtaggcattgaaaatacgtatcacgacatgacaaatattataagattatagcaagccacgatcatggccaagataatcgttcgtctataaagctttaatcatagaacaatgtctcaattcctttttgtcactaagtcaacaacattgcttctgtatctatttcagcccaatctaccaacaagatgcggttcacgtccttcacccacataatcagcttggctgccctggccagagttcaagccaaacctttccctcaggatggcgatctgaatctaccaacgcacacagtcgcaagtctcaaccagacaggatcatggttagagaatcttgccgtacgtcccaacggagatctcctggtgacgatgatggtgccagatcccacgctttaccatgtccaatcccccggttctgcggatgcacagctcgttccgctatacaagttccccaacgccacgggccttgtgggcattacagagctcggtaacgacagatttgccgtgaacatgcataacttttcatcatttgtgactccagttgccgacactggagctgtgtgggagatcagcttctcaaacacacacaaggatgacttcactgcccggcaagtgactgtcatcaagggagccggatttctgaacgggatgactccttttaccacgaagagcaacaagtcgcgcaattgcaaggcagagacaagtctcatagtggcggactcctacgcgggtgtcattcgccgcgtggacctctcaactggagccgatgagataattcttgatgcccccgagctgaagccctcaacggctagtccttttggggttaacggtgtccacgttaggggagatcatctctactttacaaacacggctcttcgggcgctctaccgcatcgcaattgactcgtcgggctatcctttgaagaatgctgctgtggaagtgctcctctcgttgcctgatatcgccattattgacgactttgccttcgataagaagggaaatgtttgggcagccgcgtcaagcaataacaccgtcctggtgatctataaggacgggggatccaaggagtatagcacctacaagtccgctgcaggagaggtcacctctctcgctcttgggggagttacagcgacagcctttggaaaggggggtgattcacacacgcttttcgcgtcgacttctggtgcgagcgcttttcctgtcaatggcacagcgaccgagcctgggaaagttgtggctgttgatctgtctagtgtcctgtaggcctgaggaaacaaaagggagattgcaaaaaggagcatacactcggtaaaaataaagtcagtagtagcttgttatcaatttcaaatcatcatactgaggtttcgtcatgatattatccagtcatgtagatttcacgtttctggccatacagcgccttcacatcaaatgaagcctatggaacgcgtgttcatgccgttccagataatatagattattgagacagagaattgactttcttccgcatctcatagcttgaagtcgtcggtgaagttggcctaactttgaccagattgctgtaatttaatctgagtatgccgaagttcggactcatttagtgagtcgtgagtcacctcatataccatgcgggatgttttcaatgataaattggcgcagcattgccttcttgatatcacattgtaggaggaccaactacaatacgatgtagtagctcggccatttgatgggcttagatgatgctaataataattgccagcggatctgcctctcaacttcccgttggctgcctcggccgacgaataatgtccatcatccaagaccagagtaatgtctgttggttgaacaacacctgaatgagctagagctgtggatctttctaaatataaggcaagtacttacgtatctcacatgcactgctcttgtttaaaagcagtcgtctgaccaacaagacgaaaaattattctttcctcccctccaccattgtgctgccttgaagatttcgcattcaaaaacccaacgggaagatggcccacaccgatagtctcgccactgccgagagaaggcaggctacgatccagagtgaaaaggcatttgtctcggaagctatttctaagctgcatgccattgcacttcaagtaccccgcttggcaggcaacagcaacgaatgtggtgaaaaaaaggagctcaaggttttgctaaggcagctctacaccgtcatatgcagactttcagattatcggcggggcaagtcctacaacccattctcagaggaagacgacaatgaggatgaaaaacttgagaacaacaacggagaggaggatcaaagtggcgaagaagaggttagtgggaatgatgacacagatgatgacaatgactccgacgactccgactccgacgaagacaatggcgatgacggcggcttccgttctggcttcaagaacatcccgggtggttttgagctggatcagatactgcttagtggctggcacgccgtgctggagccagtcgacgcactggccaagtttgatcctgatggccccttcctcgccgccaggatgatcctcttcacccagcacgccatttccaaaaataaagctcttccaaagagcctcgcagatggccaagagaggttccagctccaggctgacctaggctaggatcttgatgaggcccttctcgttcagctacgcagagcatgggagcagggtgaacagaaggatgatatctcctgggcttcaacgttcctcgaagttgataactctaatagcgtctccaacgattacaatcgtgttgtcatgtctgcatgctcttcatatgagttttgggaagtccagaagcaagcagcaaagtacatggtcaaaaacaggaagcggcggcgggggtcgatgtgggatggtccatccgaacccccatcgaccaagcacggtcccatcgccataccgctgtttaacattattattgaacagctcggctatggatcatatagcgggatggggtacaggggtccttgcttgcgacgctctcattatttcgttcaagacatacggcagaaactcaattctgctatgcctgaggaggcacttcgcttggtatcttcgcttctccatcaacacatccctcttgaactgcagacggctattctagagtatatcaacccttcaggaagtgcggatattcatccatatctttccaggttggatattggagctgcctacatcccgatcccaaggcggatggttgacgatgaggagtgcgaaaaatgcaagaacaccatccttggacagcccatctcagcccaagccacatgcttcaggcaaaacgtatacatttggaatgtggccttgcgggcctttcacacatttcacaggggacaagatggccgcgtttccatgtgcaagcacaagggcatctgctatggccaccactcaaacgaagaatggcgggtcacatcgaaagaagatgttcagaagtatgccctcgatatcttcgaaagccggtgtcatatttcctcacttccgacctcagcccaggactggttcaaggccatgacgacaatcaacccacatcccggtcccgtgtcaagtaattattataaagcaaagcactacattcggatgagatttccccgcctaggactaagggggggagaggctgatattagatatcgtaaagagggtggactctgcggcttggtcttctcgatgatccacccaaaagtgcacaggcaacatccagatagggcagatccgttcgacgtcgacaccaacaagcctggacaatgggcgtatgggcggtctatggacgaggagaaagaggtgactgaggctctattcaaagatgtcagaacacaagaggaatgagaggaagaggtgcaaagcaccgatgattcgctttcggaagaagattagagggtttatcttgcagaggcctctagctttgcattatcactcagaacaatctatccgagcatgtttctgtttctgagatcaagtagtgattaaatgcacgaagttcgctcgctatctccgtctgatgtggcttgtcacatcaggataaagtgtgtaagaccgcgaggttgtagtcttatgatatcttagctgttagttttcaggtcaactgccccaatatccaagtttaatataaggaggacgcaagatggaccctccagcattatcgaaacaccttacactgcgccattaatgggcgtgccggcccagctgcgatactgggtccgagatgtcagaaatatcaatgagcttccagtgagaaggagcattatcacattcatgagggatctaattccttaatactaaagaagcgtttcacgcagtgccttgaactgttctcctggatctatgaaaagttatttcgttgtaactttgaactcaaaattcggcgatgcttccaaatgaattttctccgaatgctcgcttcgtacagagtttgattcgcctgcctgtccagaatacgaatcattgtcaggatggcgacaatatgatggcatcaagagcgggcttaaataatccccgggactcacggacataaggatagcctattcccgcaccacaattgaatattaagtttggccatctaccgcaaaatatccattcttctggttgaatcacttgaaataaattgttttgcatgtcagttcctagaaatataagcacttgagctaccgctatttcaaccatgtctttgtcttggggtgaaaagaaactcacctggctcatcaccggtgcatcatcaggctttggtctggctctaacacggctggctctggagggtggtcaccgcgtcattgctacatctcgaaatccatcatcatatcctgatatcgaaaaggaaataacttcaaaaggtggtgaactattggcgctggacatcaatgctcctgattcggccgatgtcatttacaagctccaaggacaaggagtcgaggttgatattctggtaaattgtgccggatctgccattctgggccctgccgaaagcttcaacgaagatgaagtcagggctctagctgagacagcgtattttggtccttatcggctcatcagagcggtagcccccgggatgcggacaagaagaagaggcatgattgtcaatgtcagcaccgggtcagccgtggatgggcgagagtcaatggccgtatatggtgccagtaaagccgcaatggacagtaagcttcaccgtgtcctatacttagcaatcgatacagaaacagctaacactagtcaagcgttgatgcatgttatggggaaagagcttgctctctttgacattcgcaccttgaccattcaccttggagcattcgatacttctttcgcaagcaacagcgttagaaccacttccaaaccccttccgtcagactacaatggtactatagttgataaagtcgttgggtcggtcaagcagaaatttaccccagatggtgaccataaaaaagcaactcaagtaatatatgaaatgattacgggagaagggtacggcaaaggaaaagaatctgaacgcgtcatgcttcttgggcgagatatgtgggcttgtcagcaggccgctgctgataaagttttgcacaagatgaacacatttgaggccatttgtaataatgtttaccttgacaagtagttaggttcataatgacttcatggctcgttcgctatttatcatatgcagattggaggtcttcagcatctcatttctcttaacctccaccctaatagttaactatttagcagatattcttacagctttcgatttcgttttaacggtgatatgaaatatttcatcatcatatgcgcactgaaaggcgttgcttaagatagagctagcattaatatcacggcatacacatgccatccggcggcgccctgttgtaagcgtaccaagtctcgtcgtcgcccagctcgacatagtagtgagtcgaaaccacgcccagatggaccttcatccaatcctcattgtccacaagctccccatctgcgtccgtcgccttctcttctggtatcggatcggcccaggccctgactaagttgacatggtcgccgctcagtagagcggcatagttactgctggggtcaggcacaaggctgcgcagcgcttcctcatcagcctggacgaagaaatcgtaacgcgagccgcgggtggtcccagcctcgcaggcatcgaggtcgtagggggcgtcaacgcgcgcccaggcgaacctgcgccttagctcatccaacgacgcgccttcgagctccgggtctgccacaaaactccagtccatccggtccgcgatctggggcgcgtcaggctcagctacgcactcgcacagatcctcgagcaccagcagctgcagcgtcgcccaggccgcgtccagctcgggctggtacgccgtccggtacacgacccagccccatttgtcgacgtcgccggcggcgatttgccgctggatgctgcgctcaggcgattcgcgccactccagcgaaggcgagatgatcttgagtgccttggcgctgtcgaaatgggctgaggtgctgtgggagggaccgcgcgtctgccgcagtacgagatgcagatggtcgtgtagagtcgagagcggaggagacatagcgcacgacttaggttgctgctcatgatgcgtggtatcgtggccatctgggctttcttgcgagcgaatgtggcagagaccaagcgtccagcatgggaggaagaaacagaatatggcattggatgactaaagtatatcagcttccacacccatgcacgaggtcttatcattacgactgtattacttctccaatgctacagtctctctcggtatcaagctctcaatttcaaaaatattcctgtaaggtcgatcaaaaccgcaaagtatctacgaaatgaaggttatgaccaacaatagctagttgtcttccatcaatgacacattcaccctgctatatcatgatcttgaattaaaagtagagtgtgtgattcaacaatggagaaagaggagtgttcatcccaagatttgatgccagtgagcaccactaccaggcccatccatgcatgctgtacgtatcattcaggaacttgattgctctatcgaaagctctgtccttggcttctttcgtcactgccgcatccggtactagagttatgttagaagcactcttgggtaaacaataagccccatttaaatttcttaccttccaggtagccatgaaaaccctccgactctacatacacttccacccttccaggctgctctgtgttcaacctttcggccaacgcctgttgttccgctactaggatatcgatttcgggtatcaccataagcatccggggcgggagtgtttctcctctggcaatgacggggttcattcgagggtctttcatgtgtgaggcccgtacggggcctggataagaatcgaaaagcggcagcaagaacgccaaagggtcagttttgggaaacttcgctggtttaagcttttcccaaggtgggatacgaaggtcaatcgaggcataaaaggtaacgctcgctttgaaggcagttggcgaaggagcttgcagttcgggttgttgtgtagctgcaagggctaggtttccacccgctgagaacccaccgatggtcatgagggcactgtctgctccccatcgagactcggcgttctttatgatccatgcaatcgtagcatcaatatcatcaatgccggcagggaagggatgctccggtgcgtatctgtatgtaaggctcacaaccacagcgcctgtttcgatagcaaccctctcatcgagccgggcgttgctctccgggaggccaccaataaatgctccgccatgtatctcaatgtgaagaggccgaagcttacggccctttccagtgccaggtgtcttaaagaccaaagcacggacggaccgccttggaaatactggcaggtgctcaacatagaaaggtcgagagaaaatatatgggaacgagccaatagagtaggtgagtagtgagatgggttgaagtagcgcaagcctccagcgatacttccacggtattgatgagttaaagagagccacgcacaaaggacgaaaccagctgtataaagcccacatctttgcgtgattctagccaggatcgatgtttggaccggcaactaagaacaaagaagtggttagggttagttgaatgaaagagtagagattggaggagcttttatcctcaaatgtcttcatgtagattagcacctcaaagccaatttgcacaccattgaccaatcgggtgaaggaaattggtgagtctaaacctgattcaataagcgaacgcgaccgatacgaccagactcttaaagacatgaaccaccaatgacatggtcagacggacactaattattaagtcacatgataccgacaattcaagcatttgaaagcacatattcatcgttaaaagcggctatagcaaactagacatgatgattgtgtgtcaaaatcagcgtttgtgatatttggtcccaagtcaaagagccatagtctaaaaagatcacagctcccttagtcatgccgctttgtccacgggctcaagccttccaaaaacttttcatgaactgtacggtcaccagtgctcttcataaaatcttcgaaggtttcatcaccttggaccttgaaaaagagcagaaccccggcccagacaaagtcagtgtagctgacttgttctcctttgaaaaaggggccttccttttcttgtagcatctcagtgatcttctgcagataaggcgcggcttttgcaaatgcctcgtcccgtggtatcgacttcgcatattcttcaagcgtcatacccagcatttcctcgcgagtcttcttgaagaattcgacactgcgttcactaagcaggcgtgctggcacctgagtaacataaaccgttgtcaaacttcccatccccccctttagctgctctatcaacctcgcgtaaagttctggatccaggtggatgctgggttcaggatgcttttcctcaaggagagccgagatgtgtttagagtccatgatgtaagtgccatcagggagccgaatagttggagcggtatatattccacctgccatttcatttggcggtagactgagaggttggaaacacgtattagacagtgtgggctgatctcaaacggttaaccttactcactgtggctcaaatgttggcttgagatcaggatattcgatctacacaatatcagccgtcaacctctcctcaatgtctctcgcaaggagctcacccattcagtcttgtagtctaggcctttataattgagtatcaaccggactaaatcgaccgttagaacatcccaagagctagatacatgttcaggcatactatacctctccaagtgttgaatgaccagcatgtcttcggctccttagtcggaatatcgaagaaagtaatggtattgtcagtcgacatgattagttgtctatcgttgatgtgtatccgtggaactattttcttgcgccgattcttacgtgttaggggccaaacgctgataaaggaagaggggaaatgtcaagataattaatctcaaatgggcttatgtcatatgatcagcttgtcgcgtaatctctattaggagctggtgaaagttctccgctgtttcagtctccataatcaatactacgactaaagtagaagcttgtaagtgcccctgataagttcccgttcgtattgcgaagtcaaataaatccggaatcttattccccgccttgataaactcgatccttcgaccagtgctgacccaccttcacgaaacaagccctcgggttgcttcgcaacagaaaccactgctctatggtatagagatgagttgcgtgtagattccatagatgcggattcatcccttgaagtctccatcggtaaattgaccctctttcctacctgagaagaggcgaaacccaacgagaaacccgacgacaaatggatggctttgatctactttctacagttcgaatcaaatgagtgatctatactataacatactgagctctgtcgaattctactggcgcttctaaattagctgattactaattggtgtgaaaaataaattacggatgattgaggagatgtagcccacaacataatcatgacttactagttgtcaattctgagcaagaatacatagtcacgagaagtaatcgaaaggattttcgaactccataatgcagtgattctgcaaggcaaaggcttccatccgacttaacatggttgggggccagcaatatattgagacgaacccttcaatcatcaacagagatacacgtgaatggcattttaactaccgtcgccagtcaagagtgggctccccttggaaacgcaactttgacagttgatcagcaataatccaggaaactgacgctccagggatctaacatttggaattcggcctggtctgcttggaattctacatccaaaggcaagcgtgctgactcctctgtgggaattctgaatggccgcattctctatcacactgagaatacttgggcagatgcaaatttatcctttagacctacttcgcagggatagtcgtagctcatgatggtgccagaaaatggcaagttcgcagctgcaagctcactcatccggataaagtttcgtagacaaagatctccgatatgagctcagatcacgggcaagaaacactttttaaagccacaccggcaattagaaaagctaccattaacagccaaaccagaggcttagataccaaatccaggctctgattatcttgccctgacatgattaagagagtgggtgcgcccgtgctactcttatcgattcctcttgcaaactttgttacgtaaatgctgcacgttaccattttttcaacgaagtgaaccatgagttattctttatacggtttttattttgatgatattattttagacggtagggagaaaggctctttcggcaatagtgtgctaaatgcttaaacttgtacctaccctatagccgatcaacattgcggctattcgagtcaattaccctctttgccgcagaaaagggatctcggtcttcttttttcttgaagctgttcgattgaattatttgccttcgtgaagtatagagtaaagatattacagccaactgctgggacatgagaatttgaagcgaccaacatatcaacatgtaccagcagttattagaagtctccacgcccccgtcattgacttgatcaaaagcaagacaaggcaggtgaggtttaatcattttgtcgggtcaagatttgctagtggctcaagaaacaaagccctctacagttcactgacatctggggcataccagacgacggttgaatctaccaatccttttgtaatatgccttctccaactacttaacccccttttgacaaccaatgttacaggtctccactcctggaatggttcgagaaaactcttcaccccaaatgactgagcggctctcaagccccctcttaaaactctacgctaggagaaattggcaacgcttttgcttcggacgactgccgggctttgaatgaaacctgattggtccccaaatgtgcatatcgtcatagtacgagtagaacggttaacacaattcatcttatgctcacactccgatctttgttctttggagctaaagccaagggacgtgacaactaccggatcccagcaggccaaaaactttgcaatcagaggcacgccttgagtccgtccttagggcgccaacactcgggttacgacggagtgcgaccaatcttgaaaaattaatgtcatcataccgatccccacagtctttgtttgataagatgttttcatcccttgtggactcgctctcggctctaagttccacactgccattttcgaagcaccccgcggaatctcattggctaccggcccgggagagaaaaatattcttgctgcctagagtagcggtatatgatgatggtggtcaggggaagtgccgagggttttgtttttgttactagttggctacagttaaagctgttccagctcttcaagctctcaattttcctcggtcaagcacaatcagtatcacgaattgagtacaaaataagcgcaaatttatccagccttatgaacaatcccagaaaattcggtgaacggcttcctgggaccatggaacattgttgatggctcggtgcttctccggtgttggttccctaaaagtccacccggccaatccgctttctactgaatcagcgagtgatgtagctgcggaatgtcggaggaccacttaatgtcgcctcattgattgccggggcgaagctactgagatcccgagcccaccaaaaccctggcaaaccgaacaggagctctgtagccaattctccgccgcttctttaggaggtttcacaggccgtgtttgccgtggtacgtagcatcaaaagaggggccgcgaaacgaggcttcagcacaatatgacggagcctgcttccactccccaacaacaacacttccattctcggcacgacacggggaactgtatccatggggtctgtcaatggagaagggggagcacggggaaacaatttggagataattggggttctccgatgtggggattaacttagaaaacgtgtgagcccggttatcaataaatatcaggcatggcctgccagtcgctaacaagtccagctcatctgccctgccctccgattctcttctgtcaaggcggccaactctgaaaatcgtttcgccatgtcgtcccaagtgattgatgacgccaagcaggacattgctacccacgatgagcttcaagactccccggcgccggcgatggacccagcccgtcgagctgaggttgagaagagcctcaagcgtaaacttgatgcgcgatgcagtctgttcgtgctcatttacatcatgaactatctcgaccgaaacaatattgcagccgcccgtctcaagggcttggaggctgatctcaacctcaacccgacccagtacgccacttgcttgagtattctctacgtgggctacattctcatgcaggtcccctccaacatgttcatcaatcgcatccaacgacctagtgtgtacattgcctgctccatgctcctgtggggagtcatttctactctcacgggttgcgtgaacaacttcggcggaatggtcgctacccggtttttgctcggtttcgtcgaggccgctttcctgccaggtgctctcctcatcctgtccaagtggtacactcgtcgggaactcacgacaagaaatgctattcttttctgcggcaacctcatctcaaatgccttctcagcccttatcggtgctggagtgctgtccaatatgcagggtgtattggggcacgctgcctggcgctggctgttctggatcgagggagccatcaccatgagcatcgccatctctgccgcctttatccttcctgatctccccaccaactctcgtggcttcacggaggatgagcgaagagtagcacagctgcgaatgatggaggatgtcggcgaggcagacacagactctgcagagcagggcatgttcgacggtctgattatggccgtcaaggatgtcaagatctatgtcatgatgtttaccttcactgcctacgttgtcggcctttctttcaacgcctttttcgtaagtctcatcgtccttgatcttattgagtaatacttaaaaacaattgctaactcgcttacagccaacccttaccaacactctcggctttggctacgtcccgactctgctcatgagctccccgccctgggtgttctcatgcattgtctcagtcattgtctcatggcactctgatcgcacacaggaaaaggtacttcccaagccatccgaattgacaaaccgtcaagaaaatagaccaagattgctaacactgaactcagttctggcacatcacctgcccaatccttggtggaatcgtcggcttcatcatcagcatgtccactctgaacgtcgctgcccgctatgtcgccctcttcctccaggcatcatcgtacgcaggttttatcgtgttttactcctggatcagctcctccttccctcgcccacccgccaagcgtgccgtcgccattgcgatgatcaacgcattcagccagcttggcaatatcgcaggatcgtacgtctggggcttgagcgacaacggcttcagaaagagctacggaattgtgctgtccatgttcggagtcacgattgtgggctgctttgccttccgatgcatccttgtccggctcaacaagaagctggaggaaggcgagtcggcgtgggagacgaggccggatgtggctgagcagactgctgctgtcgagattatggagaatgatgatgaggctttgcgtgtgcggaggggattccgctaccttgtgtagtgctatactcacagcttccaccccgactaaattgcttcttacatctagttacaacaattgacggatattccaaaagtacaagtttcccatccatgtccagaagatgtgaatgcatcgagttgtttgctgattcaaggtttcaatcggaaggcgggagtcattggagccacaataactgggtaatgggaaagatgccggatgcaacacttcccttcaagaatggcgggcttatacagatagcgtaggacgaataaggtgtaacgtgtagagtaagcctcatactctcccttataagttccctttatttgaggaagaatacacaacaatgcacatcatcgtcctagccattcacgatattggacaagactcgactcaccagttgcccaccctaattggagtttatgcgacatcctaaccctatgtgatgctctcggacaacctcgcggaatgaagctcaatcttcctcattattggtctacaggtcgagagagtctgggtctgagctggccgtgccgaaatggctatcacagcaatccaagagctctccgctcctactaacggtagcctataaagggatctccatatttaatctcctttatcgtccattagaagatcagatatctatatgctagctgtattagctcacaagcgttgcagagagtgcaggaatacttttcttttggaagacggaagcaattctcggtgaagtcatatgtaagctttgatgacgtgtcaatatactggagcagatcatggactatactcacttaactagtccgaggaaaagaggatatgagccacgagagtattgacaattgaaaaggctagaccagacttatgggtaaatgtgtcacccaaggtccaacgagtcagatcagaaagcgggataaaaggtcggtctccataacgcgcggccacacgaagaaagccgtcgcctttttcttatcccgtactattatgtattagaaaacatgtatactaaacttatgccagtacgaacaacatgagatttattttgggctaataatctttctttcgttgatgaattccagtcttagctacccgcccaatgtgacagcaattacccacaatacatcccgaaaagcatcaaaatatcagagcaaaacgtggaaaacgacacgagtctcaaacttcccaattctctggatagttataatatccaacattgctgcgtctgcggtaacaacgtgcttaaggtgcggcggggtaaaagtgacttcaagtcctgtcacttgaccatggattggcctaaccgcagtctcctccaccccgagaatgatttcgcaaagagcagcaagacaagcgtgtggccaatgatacatatggaacctaggattgtgactcagcgggcgtgaactgctcccagaatgggccgctttgggcttgtattaacgaacgccgagcttgtggaaatgtcggtcaacctgacgaccaattacgtgcgcaaccggagaggcccagcgacaactactgacatatatagatccaagggtaatcccacaactagagaaagaatgcaccagtgccagctcgatggccacattgacaagttcattcatttcgaccaccacagccacattgggtttcgcgacatctggttccgcaacatccgctaccagtgcttcagccttcagcagagcccaccgccttccagggctcagggacaaacgcggggaggatttcggctaccaaatctgttccacttgccggcaacttgttatgtccgggctgggtagtctgcttcatttagagcttagtcagagctgccagttgtcagcaaatttcgcttctacaatttgctcaaggcgaaagaatcgattcatcttggaccttctatgtgccggccagaattccgctgtgcatcatgggctatctctcttcctaccaagggaaccacaagaatacgttgacagctcacctctttccactgccaggaagtgaagggtcaaagcgagctgtgctggagttttgtgagtcggcagatctgacatgccggacagggaatctcaaaccatagctgtcttggcggcccagtttttgtacgctggcacaaatcgatatgtgctgtgcagagcttcctggcttaagtgcatattaatagcaaagaacgatcagctgctcaaaagccagtgatttttctcgtgctaggtgcaaaagactgggtcgccaaggatggcgattccaggtaagacgcccagccttccagccaggtcaatgggtggctgtgctcctttttctgcctggtaaagtgggggatgaggtccctggagaataatgcttgcaccagtcttttcgtgtttggtcgtagcgtgttcttaattacatagtctaatgaataggttaatcacgcttggacgcaagtgagtagctcgggccagtgagcttgctgtgggtgggcttcacaatcaaaagaaggaggctaatgagcagagctgaattcagcttcgaaccagtctgcccgtgcggctgagagcattcactgtaggcttctgatctaggctctgcggtaaacaaagatgtttctgtcttctgccctttccctgaccaagtcaagacaagagagcaaccacaggcggcatacgtcgggacccggtcattcaccattaatcacctacccgacgctacctaccttgcttatgagttttgagatgggattgccactgagggagtttagaaagagatgcaatggtgagctctaaatttaataaccagttgacataaattcaacgcagtgatattgtcatgatcttgagttgctgtgtttattcttaaatagaggcttagaactatggttaaaagggggcaaacacagcccacatgtctgacaaccacggtatgcaactcgacgccacttcacgtgggagtgaggatctgtacactaggaggagcatagcaccagcaaattctctgcatgaaacccgttttggcccccaagaaggagaattgccctcgagaaatagctccaaaaacatttgcatgaccttgcagacctgacacgtcgtcgggactgttcagccctgcattggtaagcgtaacagtggcccctgttcagaggaaattcagtggactttagcggccccttttgagtggccaagccaggggtcaaggctccattctagtcgaggggctgtgatggtagtggcccgtcagcaccgccaggactctagacctggctagattgttgtgagctctcggacttgtacaggactacaaaggctagtatgcttactccagccaggtatcccatgtcgatgcatagggcaatgcccaagccagcctgaccgattgttgattgctattaataaaatagcttcggatgtggcttgcagagagtatcgatataagggtaactgatgctcccgctcagtagttcactctattctctgaatcatccactctcctgtcatccaagtgccggactatttccttttttacagttaatattccgtgttgtgtgagtgtgttagcaacaagtcacaatgaagtcctcgatcttcgccgcagcactctccctgtctgctttcgcagctgggctttcctccgatgacgatgtttcaactatcaaggtcgtcggaggagaagacgctggtgcatccgacttccgcttcattgtgagcatcgagagtacaatcgagggtgaggagggccactactgcggaggtaccctgatgaacgagtggactgtcctcaccgccgcccactgcctcgttggcgagaacgccggaagcacccaggtccgcgccggtcacagggtaagtgtctttgatccactttgatcttctttgatttggtagaaagctaaccgtgagatgaataggttcgcaacactggcggtgtcacagtcggtgtgacctccttctggcgtcatcccaagtacaactcgaccacgaccgagaacgacattgccctgatcgagttggatgagcctatcgagaagaccaagaacattacctatgctaccttggctgctcccaagaacgaccctaaagctggcctcaatgttacagtcgcgggctggtacgtgaacctaatgcaataaactttcgtgatgggcaaaccactaatcttggttctttttaggggtcacaccaaggaagatggtgacttggccgtcaacctccagaaggcttccttcgctgtcgttgcccgtgacgagtgccgcaagaagctaaagtcccccgtcaccaacgacatgttctgtgccggaacccctgctggtggcatcgactcctgccagggcgacagtggcggtcctctcatcaacgccgagaacggaaacgtcatcggtgttgtctcatggggatacggatgtgctcgcgctgactcgcccggtgtttacgcccgtgttggatacttccgtgagcagatcaacgccgaggcttggtaccctgccaacaagaagcgatggatgccttttagcatgcacaaccgggccgtcaagggacttagccaataaagcaccagcttctatgtatatatacacgggatataaaattagcggcttgacaatatgggaggttttctctcatttgatttatgacttgggtcaacagggacgttgatataaagtagcatggcattacgaattcttgcatttataatatattggcattcacaattacggttataagttgatattattccccttccgattggttctatgcccacaaacctgactagataatgtaattcgtcgctatggaggttctcttgtttcaatcccattatgatatcgtatattgattagtggcgctaccaagaaaatatcacaactgaccgtccatttaaacctgagtcgatggtgacgagggaacgcgatgatccccttcatccgaaccaaatgcccagatatgactctttatgctgagtgaggagcggcaaaagtcgaaaagaagctgtagtatctggtcatagtgacttggttcgggggtgaacatttgccaccatgtcagcttaacgtagaaggtgatatctttcgacgagaaattttattatctttggcccaatggctgtcactactatgatccaattttatccgaatgaatatgcctgttcaagttacggagaggtgcgttatactcgtattattctattagaggctacggatttgaatctggacctgtcaataagacaccttttggaatacgcacaagaattccttccgacgaaatacatcctttagttgcggtcaggacggtttcagacttttaatcaagcgctggcaatggctatgtacgggctatatcttgtcctaattctcacgacatgcaaccgacggcgtccgcctgcgcaaatcaccactacatagggaggattttctcagccgtcccctggctctccatctctacgttgatcataagattcacttgtgtaatcctccacattttggacattcatgtcaatcctccacgactggagaataggccacgatccttccatcactataccgaaaacaccttcggttatacaagaggtctaacatagagcttagaccccgttccaacatttcttctgcaagatctcttccaaataaggtatgctggcatttctctgtgaactggcccaggagcaattctaccatagctggatactcagaaagaagtgcttggacgacaatggtgcaatcacaaacagcaccatatgcaaggagtttctgagcgatggcgatactaccggacttgacggcgccttccattggacggtgaacttggagacgagccttatgcacgtctgcaccgtattcaagtagcagtttcaccacatcttcattccccaaacgagcagcaaggtaaagaggggtctccacgttgccattatccacactgccttcggtaaccttgctgtctccgtcaacatgacacccagaatcaagtaacttcctaacaacatcgaagttgccgtattcagcaaaacgccttaagtgcatagcacgaacgtgatcgggtacttcagggataagagagatcaacctggtatataccgctcagtttttggcgaaccctggcactttcccgagtagaaatttgggtctccagtgctttggcaaattgccatctccgttgggcatatagtcaaagtaggaagcagtctgatcagctcgagaggggggatatattgccatctccaaaatcccggtatcaccattcatagcagcaccaagaaccccctgaatatctgccttacccttctgatagatttctcccaaggagaaatggcagagaaatggccgtgtctctgatccagtatcgttatagtgggctcaacattcgcatttggctggctgctgtaactcggccaatgcccaattcggcattgtcggcaaccgtgtctcttggcagtaataaataggctcgctaggcatccgcttgttatgaaattaaatgacccgcagggttttccattcacgcctccgagcctgagtgaccacattctatcaaaccacccgctaactgcccgccatcagcccatccttcatcagaagtaaccatcctgaatggcgattgtgcggcgaaaaccgaccgtaaggccgtgtgacatcaaccctgaacggcgacagcgacttcgcagcgactccgacgatgaggggccgccgaacagagcgacgcgcgccctggaagcaatggaggacataggcagatactcggtctattatgtcagaagaggcgtcaatgctggcttggacttcatattgggcaacctgaaatggattcttatcgctcttctcttctcttacttggcggatctactacttaagagtcgcggcgggcctactgctcgtcttcgaaacaaatacccctgcggtataggaggcgtttcgcacccaatgtgcagcgattgctcgagttagccgtgagctcgagtccctaggatttgggttgagaatggaggcagatggtcgttgtcatgtggttgtgtcaaaacaacaaggaaataatttcgtcaatgattggagacaaggaagaatcgcttctatttgactatacacattgaattaagtgatgaattacgaaaggcgtcgcagtcttaggtactttgtcttggaagggggcctaatggagcaacatgcatctctgataaacgcggatgcaggcagcgtcaatgaatatgtggtagcggtattgaggagtcgatggaaccggtgttggaatgagcttttttttttttcgcccaagagggtgaatactaaaccgaggccaagttgacacggctagacaacacatctatgatacctggaacagtgatcttgagactcctggccttgaccaaatctattaacaaaagagagatcggctaagtactagaaaaagctaataaatagcattatcttctcccacctcacaatacttcgtcaattccttccggagctgcctctccccctccccctggccgtcgccctcaatgtcaaatgcgcacatattaggaagtatgttggctaagctttttgccaattgaacaatacggtcgctttgtgcctggttctcccccaactcttcattgaacggaagttgttgctggttttggtgcaacacaaggtgtaaaccccagagactttcggacatcaccgtttgtctgccgtcgtctccagcttcgtcctgtatctcgctccattcaatagtgattggaccgataattaagtcaaacaacttggggtaaagtctgcacagcgactgtatagatcgtaaggtcatcggttcctcgtttgtctctatctgcaaacagaaggaccaaagacgggggaggtaacgggaaagttgttctatggattcatcgttcaaaccagaagttacagggcgatggccgtcttcagctatgagaacgtacttcaagtctgaacagctgcgagcaattagaagaaggtgctgagcgtcaaagctggaaccttgcgcgaacgtcaattcgagggtcgttaatcgcgtgaagctagccaccagggaaagcgagggggatggagattcgaaatcgagctggagttcgagtagatatgggagggatgcggccaacagtgctagcccacgatttgaaatgcttgtatcgagagatgtgagcgcctggaacccggtaacctcctcaagccagaattcttcaatgaaggggaggccaacacgatgcaagttgggaagctgctcaataatacgaaagacttcttctgaccacaaaccatcaaaagcatgttgtatcagaagagcccttagttgcctggacctgctcaaaaaccgtactaggccctctccggtcaccgtattgtctgtgcagttcaacaaatataagtgcataagccttggacatttgctggacagagtgtctaagaaaacgtcggaaagctggctgcacattgtaacatataaatcgcccacggttggttgggcatagtgaagcagagcctggcctgtaataaaccttgtagtgctatcacccacaacgaaatatactgtctggagttgtgggaattgtagcgacaggagctcatggtgccattcaaactcgttgcggtactcgttgccttcgaaccactcgctaaactgcaagatacagatgaagtttgcatacatctgcgctcgctgcggatcttttcggctcactgagatgagatgttcgacattggctagggcatggcctgtctcgctcggtgtccaaactcctctaccgcatgcataccacaagagccgagcagattcttgaaagaagacgcgatttactaaaagacaagtgtacaagtagcctttgcaaagactgccggactttacgatgaccgcaactatctcaggaacaacgaagaggtggtgcatatttgactgatgtacggttgaatcggattgaagttgcttttctaggtggagaagtgagttgaaatcgtgaaatttttaccattcacttgtgaatggcgattattattactcatcagacatgcaattctgatttgaatgcgcacccctgacctgattttgggaccaacaatagccaacatcaatagatattgttggttccaagtagctgacacatcattaggtcatttgccgctttgtggcctttttgacttcatgatcatggtttcaaatttaaagacagggtaataaaatatatatgaattataccaagaacttcgagtatatcaaataggtgcgttgtgtaggccaacagtcatttccactgaaacaaccacaccagaactgatatctgctcttgaactaacaggttgagctgctgcacagaccggctactattgcataggtaataacggagtgctgatggagccaccaggctcaaaggattcggttcgagtgcccgaaggaacagaattcctcgatgtgactgaattcacggtagatagttccagtcagattcctgccttctccaataactatggcttatgagaggtcgataataatggcacgcttttctagtggatatcaccacagcatgatctcctacgccaagacgaaggattcgttagttgaccaatgcttggctgatttagtgaaactgcagccgccaagcttctctagcatccgtattccgagattcttgtgaggcagaaggcgaagcagaacgcgacacgccccattttcccacaccccaccaaggcagagaaaaattgattaaataggtagggagctattgcttcctgatttcttgcattctttctgacactctcctgcggctggctaacttccacaatctctcactgaatactcagcaatctaggagtcgaaaccgaaaatggacgaattagcaaatctcgatgaacttccatctgaaatcaagtccatgattatcaatggctgcgacaaagacgatctccaagccttgcttcttaccagcacacgtctcaaagatgtcgtggaacgcaagctgtatgaagaaatcaccctcgatgagacagagtccaagggcgatgccgtcatggccatagcaaacagcccccgtgctgggattgtccgtactattatctatgctcctcatggccctcaacccatggcgtccgacgaccatgatactgagatcgagctgagcgaggctactgcagaggttctccgctctttacgcaaattccccggcttagaaacctttcgctttcgttgtgatttcggagggtgggactacaacaactggcctcacggggcatttcacttctggatgcacacccgggaaatggcagaaggggcactggcggccgaatcagaggaaccttgcaggagactgctgaacgggagccttgttgccctgtgtgagagcgcaggggctttcaaggcgctggagttgtataatctgcctccgattcccacccaagaaggggcttactcagtgtttcgaacggataaatggctggccctggtgcgaggtctgaaatcatttgacttgcaactcgccggctgcgagggtggaggcgcactcaacatgacgtgtgctcaccaagagtatattgctgacttcgtggatcatacgatcagaaatctaaccagcgtggagcgcctacgcctggctggtgagccggagggcacgattgggcactatgatgaacaagagagttttgaatggacggtattggaccttccttgcctgaaggagtttgaactggagtggtcgagctttgagtctgggttgcctcagtttctcgccaagcatgccaaacggtctctggaggagattcatctccgccggtgtttcacaatgggcttagatgcttgggagcagattcttaagggaattcaagagtctcagcccccgaagctcgtgaaggtgagaatcgaaccgtacccggtactcaagagcacaacattcgggggcggcgagaactacgacgacttgccgccgcggtttgtggaaaaatgggaacaaggagaggtgacgttcgacgtagagcttgatcggcggttcaggcggttcgtcatcgcagaaacgtgcgagagctacggggctctccaaataaaggacgacgactacgattcggatctggagggtgaggaatttgaggatcagatggaggagtttgggtcggaccttgatgaggccaagctggatggcgattggaaggctgtgcaggacatctgcgcaagaaacagcatcaaggctgcaaaggcgtaggggcatattcccatttcacgagagagatcatatggcgcgaaatattaatctggtacgcaaatgggccaggcagataaatcatcttggtgcattcagattcaagttcctgtgggtgaaatgtccagcgctgttcctaggcaagttaaaagccacaatgaaggcgacggcgggttctcgtgccacctggagaactattcgcattgcacccgaccatccatggatactgcacacattttgttggtttgtttattgtcggtctgttgtgtgcatgctggtcttgagtgaggcagggctcgcgtgtacagggagtgctccctgtaagcacagcgcatgaggccgctggaacggagcacagcaggtggctttaggcagcagccgcccactaagccaatcatcatccactgaacgaggttgtgccaccgtgaattctgctttgtgcgctgcaaacaaagttcctgcctgcagagaagcttcaggttgcacctcacctcccgctcactccttcctcgcccctctctctcaccctctccttctcttccctctttctctcccctctcttcgctctcctcccttgccaccttcaccgctcactttgcactcttcacctctctgcctttcgacctctcacttctctccttcatcaccaccctgctccccccaccgccctcgtgcgatcttcgaagtccagcaccatgggtcaacgtcaccagctcttcgtgatcgccaaggccggcaagtactatcgctcgctggccgccatccatcaccagtggctctacggcatgagcgcccttcgccagtgtctgcagctcctcgacatcttcggccacagcgagaaccgcctcgccttgcagcaggaactccgtttcgcagaagcatactatcgcaacaaggatgccccctcccaggagccgccagagctctcatggcctgacgaaggcggtatctgcccgttccccttcatcaccacctgtttgatgatgggtgcttctttgaaccaggaatcggcccaggccagtgctatccacgaggagcccttcggaatgggcttcgaccagggcgacaacaacgacggcatcactgtcatcgacatcaccgacttggaaagtgtcaagtactgcttcgtcaactttttaggtaactaacccgcctcctctcgatgcatctctcgtgccacttccgcttttctaacccatatctctctcaaccctttgcagatgactacgatgcagaagaagggacccgcagtccactgtaccagcccttgacaggctggcaatatgtcaagaattactactccgaagatgacactatgactcaagcccacatccacttgcccaagaacttggacacgaagcccctcatcaacattgcgacgcttgcaggcaagttgccgttcctgagcctctccccaaccaccagctgaccttgacttgcgcagaaacatggccgtggggcaattgggaagtgtgtgatgctgtcctgcgcgacacaagccagcctgaccatcatccagttgtgcagagtttggtggacaagagcatggataagattgtagaggcactccttgtctcaaatgaaatggaagatttcaatgcagccaaagatcagcttgaggcgctccccaactcagctgccatcctcagaaagaccctcctcagccgggcgggccaagttggtaaaacaccacattcgcctttgctcctgggcctcgcctacactggcgaaactcacctcgactgggcagctttcaccaaccttgatattgcaggcctaaaatctgccttcgaagctggttccttcgcgtctgtcaagtcactgaatctttctggtaccttggcttcccgctcaccatccgagctaccacccgtcctctcaggtttgacttgtttgaagtcactgtacctgttggacagacccgatcggctcgatgatgatgagaccgcccaggccgttctcggcctcgcatcttcggacttattaggtctcgcgttggagaaggtgatcgtgtctgcggtcatgtcgattgccattcgcctcaaaacgtggctccctgacacaaatgatgcccctgatacaatcccgggatttccgattgcacaacttctagtctaccataaaaatgacgctaataatgactacggccaagtcgtaccatatgagtacttctttctcggagatgctcttctcagtcctgttcgattcgtcaatggtttgttgcgctatgtacagaccttgaactcacagaggtacataatgggtagcggttctggatccgagttggccgcttgcatggccctgagctcctcagttcccggcaacaaggacataggcgagatcggccctctccccgcccaagcctacaggtttggcaagaacagttaccatagcagcctttctcatggctgctactctgaaatgcgaaatctcaagcctggacagtggacagtgttgctgagccggaatgcagcccctgagggattccaagcacccgccgacaagggcttcgagtatgcttttgtccgttgcaaatccgacattaaggtgcgaaaacccaaggaaggggagcgaggcgacgttatggcagacaaccttgaagtatacagcttgcgcgagttccttgatgagacagccccaagctccggcactacgagtttggatcctcttttcaaccagctccgcttgcaagttatgaagactgatcagctgcccccggatgacgacgtgcttcgatgcatgaatgccgggcaatctcgagacttgctagtcaagttcatggataacattcccacgatggacttagtgaaggaacgcgcacgtctgtatcactaagatctcttcgatcagctacatggagtgccagggtattgcgtctaagggcttatacttggcatgtacagtaggttctctgttgtgcctcaacacattttaagatggctcgtatctttgttgccttgataaaaagttgaattcggaaaattgttcaggcgttgaaaatagtttacgaagcgtccaaacgagagtagtacccttggtcggaacattaggaccatcaaatatcactcacacaagtggccatcagtcgctaaaacatcttgggaggaagataaaccaagccaccatgtaactattagatgcctgctttcaataaagatgtatgcatttaatatcttctttcaaagcatgtctgatttcctagcaagacccctactgaaggctttttaaatccgcagtagatgatatgacacttaagccagacagtatcagaatttgtctgtatctgagttctccacgaggacattgagcaaagaaatccgctaaagatctcagtaccagtaaaataataaggcgcaaagttatgaatgggtgtgctctatttcacgaggaggcgggcagatacagcttagttcgtacagcttcagcgaggacaacgaataaatctcttgggataaatgggctgggctaatgcaggctgctacaggtatattgacctcatcgatagacagataatggatcacccagtctcagccgcccgtctaacacctccagcttagcaggctccatccttgttaccaggtccgctgtagttctggcagggagtttttgcgtcagtgcaaacgttgacgagcttcgcagtgtcgccgttgctcttggtgattccaacgacctcgccacccttgcgagccgtgactccctcgacgtagacttcgcgcttgcaggcttggcactaatgagtctcgagttagacatgaaccatctccagatgccctttccggtgttcgtaagttgactagggatgtacttacagttccgcatgatcggtatactttaccgtagtcttcggcatagaagttgtagatctggatgaatcagtaactgtcattctgaacacctgggctttctcgtctcgcatacctggacctttccacagccattgtgttggacgatcttatcggaagccttgaaggcgccacctcctcggatggtggtaacagcaccagcagcgtcatctttctaaagaagcgagagaaaagagcaatctcaagtcagtcttattgcatcgccaggtagtggatcttgggaataggaacgtacgatggagatggcatcctcacacacgtcctcaaaccagacattctcgatggtgcatcctcctccaagacagtacacaccctcaccctggttcttaccaatgatgacgttcttgagggtagcaccctttctcaggataaatacagtgtcggcctggcctgaaaaggaggtcacactgtcagagttcccggttcagcgagtgacgggggggaatatacgcacctccttcttgttggttcttgcaggtgtatccctttcgatcgtagcgtttgtttccgccgtcgaagctcttgcccgcggcgacctcgatgggggcagagttgctgactgtcgacgagggcgagggcatgttgctcttggccacacaggccagagccgagggaatgccgagcgcggcgaggacgatgatgttgaaggcgaccattttgatagttctaattctctgtagaagagtatattgtagagcaatatttagttgcaatcgatcagatgcagatggaaactcgtgtctagtgaagttagtctaagcgacttggaagcgatgggtggttcgaatagagttatatatgtatgtgtcatgctgcgtattaggggcttttttattccggacgaagtcaaatgaaacagcaaccaggtagaactccgagactatctccgagactgtcgaacggatgcaagtctgccgtggcagccattgacacggggtcaccatggtgtttgagaaccaagcggtgcattcaattatacgcgcttggcctgcctgttccagccaaacagcagcagaataaccgtcaatattagaggcttgccagcttcatgcagacttggctcgagttcgagatcgcccaaatgccgaccaagtttccccgtgttgtggagggccatgttccgtttccgaatgcggcagatttgaaacgtacaaaggctgattgttttgtctttgctagccttgctacattcctggatgcatatacgagcttggcagtgatccggggtgatgtgcggtgtgcattcgagactcttggcaacgtgctaggccgggatgtgaggttaagtgggcgctgtgtcaagtctcagctttgatccaatcaaagagggaagtttatgtgtcaaggcatgggatgctcacctctaatctccatgtttagttgccttgcctgcttgcttctcactctaatccacgtgctcggtctgagcacaatcaatatttctctggtgatggtacggatttggagccttggcttggttcttgggtagcctccggacggtgcattaccagtagcgctgacgcacttgatatttctaatcatagcttctgtgatttgatttatggattaattgttatgaggactacggccctccctccggaacagttttcttttgtacactccttgtagggatgatggatggaaatcctgcgaaactggtgaaggctggatcgggggatgaacagagcttacttatgctcctggaaagtggtcttaacctccctcccttgctcttcatgccgagtatgttacatgttacgttcacataaagattttgctagtcatcgtcactctgtagctctccagaaagatgaagtatacaccataaccataagaataagacaggggctgtgggagccaaagtttaccagtctctgcggattgtcaaagcaccctcaaagtccacttagaagagggcaaatactaagcaaaatagtgtcgaaaagacaatgaaggtatgtaaatatacatacatatctagaaaaactcgagccaagaaaaagcttttgtaaagaaggccaattttcctttgagtgtgcttgcgtatagggtagttgaggattcaacacaagacgcattagtaatgagccgccaagtcatttcagttctcctctcatgccaagctcgattggcaatccagctcttcccatcgtcacgcggaaaaatgacttcggttgatgtgacctccgagcctgcggatgaatgggagttctttcgtctatgtccgatttgccgaaaagcattcgtgaaaggtcggtgcgatgtcttacctacctggtatattgcgattggccatgacgtattgctggactgaccgagatgttgatcagataactcctttaagcgacacctctcgtattgccgcagagcccaattcaagcgcaagggccgaccaaagccatgtgatggctgtgcagtggccaagactaaatgcagcctggatgaaccgacttgtcaaagatgccgctcaaaggagctgccatgtgtatatggagcaaagcttttggaaggactgtttccaaatcctgatttgcaaaatgatgtcccattcagagatccgaacagtcttcactttgggcatttttcaaccgctgaagacccgtcggtgtgtttgaccgggactttagattcgcttccagaactcaataaccatccaacactgctacaaaaaagcagctggcttttaacttcctctcacattccgaatgggcaagagagtatggcggaaaaaacaagcgccacctctgagagcctccagagcttggaagtcttacctcttgatggagctgcacctgctcagtcaactgaggcagtcgaagagccagcaactctcacagcgctgaagcaatccagcccggaagcagaagccagtgccaccatcttaatgcactgtatccgctcataccctcagatgatgctccgtcgacagaccttcccaccgttcatccatcctcattggcacatggaaaggctacccgagaacctggttaactgcatgagtattgcgcagttgttcgttacccggacactggagaacagccccttcctttggcgaactatagacaacgaagtgagccgatttaagaatgaggtgagagacatggagaaatcaaacatacttcgcctaccaggcaacactatcccacattgtctacattctaacacgatataggccaatgaaatggacgcaagagtagttcaaacagcagcacaggccgtattgatctatctaatcatgttggctgtggacgaggccgaagacatgtcaagccggggtgctcgactgttagaagtgtttcaggttagttaaagtaacacacttcaaccatcctcgtgggctatcctcttgatggtaacccgtacagattttgtcctttcggacaagagacctctgtggtgggatcttcttggcccctcccgaatgcacgcatcccagtcccagctgggaagagtggatatttgcggaatctaggagacggtaagacttgtattgctctaatttcctgtatcatcgcactaatcgaccggtttgtagaatcagctgcttttatttcgccgttcgcgaagtcatacaggcaaaagccgacatcccttgcgtgccccctggtgcgcatcgccaggtggcactttgttcctccaaaacaatgtgggaggcaagatcccgcgaggagtgggaggaagaaagggctattcagaacatggggcgactgcatatcgatctttggaaccttggagcgcttctggatgctcagcggcacccggaggatccaatgtatgcccaactgcttgagatttggggagccaatacggataagatgggggtgcttatgagtgtggtggcagttattatgaaccaacaagaaagtgaatcagtgcagggaaattgagatcgaggctctgggagatctctctggagaggaacgcaagggtaatctcttggcattgggtagcagacatgtgcggtaaagacatctgtcttctaaccaaagcttcaaatctcgcagttggcaactacatggacagccaccatatgtagagatttaacggttgaccatatccgcaagagtcgacggaaggaaggacggacgtacgtcagcagtgaacaggagataatgaccacaccggataactggatccacaacggtcaccaaaaagctcccggttcaccgagcagtaagcatccggtacctggaagcaggcctgggatgatcgatggtagatgaattgaatacccttggcattattctgcgtaaacagtgatttacatagattcagagagaattccaacttttgttgttcacttaagctcgatcaccattgatcattcatctcaccatgtcaagtgcaagctcgctatcctcctaaatatccgagttccgaatcagctgatgttgttccaaatcgggatatccttgcgcatacacttccttttggtatagtgtataaaagacgcacaacaattttgaggtgcatttctaatcctgcaaagtcttcaatctaatcaatcatcaatatctcatctgaaaccccccgatcactctctttcgagaatgcctctcctaaatctaccaaacgagttgatagaaagtatcatcactctgttatgggaagaagctgacctgaacgccgttgtctgcaccaacaaggagctttatagcatgttcaacagctacctgtattctcacaacatacggcgatgcgaactgtatgaacttccctatccgcgctacgcactcgtttggatcgcccagaatgaagggctcctgacggccttcgagatggcacttgatgccaagaagcagagcagctcggaagctgccatgcacctcggacataaagcctttgagcaagctgtgttcaatgggagagccgatctgatcaagttattattatcccaggatgactgctctggagtgcatcccaactctgtcaacgaggcagttattcggggtcataaagaagttgtcagagtccttgtggcttctggagtatttgatctgaattggcccggtcgctaccagcgtacgcctcttttccaggcaatttgtcatggacatgttgaaatcgttcgcatactggtggcggccgtgaacataaatcagcagatgtggatagcagcgttgactaaggctgcagagaatagggaccatgagattgtacagcttcttcttgttgcgaaggcagccaagtgacttcgttatctacttcccctggacaagtgattgttggttgaggtttgcatgatgtctctcttccatgaggctcatggttgacgaagtcatgaagtgaacagatgacggatttgggtgatgtactttatggtaggatcacatatgacatagcatggagtttcaggaatgaacgagcttactgacttgcaacgagacttgctttgcactcacttcaagttgtcatgcccatccagttttcatacaggtagtattcagtcgggccagcgtacttgatctttgacccaaccgtcggctggcttttgaacgtcagcaaaatacatgaggttattgttcacatacgaccgagggggttgagttgtacatgtagactaaaaagaatcaggagcagagatcttacataaattcaactacggaaaggtgccaatgaagcctaacgactattccctcttccatattcatccaaatatttcccatctaccaatcaatatctccaagccggttgctgaaagtggcagttgggccgttagaatccagagtggcaagctccacgatgcgagtagcaccgacctccggagtatcaccatcatcagggctcccgctaagtcgcgtattgaccaatccagggcaggcagaattaaccttgcctccaaaatccgataaaatacgtgcatagttgatcatgagcaagttgacagctgccttgctagagtcataagccttgatatcaattggataccacctggagctcttgtccagggactcggcaaaggtacccatcttgctggagacaaagaccacacgcggcgggccctgggttgccttcctgagaagaggcagcaagctctcggtgagcatagcagtaccgatgacgttggtttggaaggtacgctcaaacagctcccaggggtccatctggttgaaatcgaaaagcacccccgcattgttgacgaggacgtcgagccggccaaagtccgcctcgatagccttcacggcggcttcaacagaaggcctagatgtcaagtctagctgtacgtgggaggcagagtgccccgagctccggagagacgcggcgagttcagctccagcagcatcgccacgagaaccaatgatgacgtggtaattgtgcttggtggcaagcgcagtcgcaacgcatttcccaataccctggttggctccggtaacaagagcaatggttttgtcggtagatggagacatattgataagttggggtctggaaagaagatgttgcggatgatgcaagtgatctgggttgatgaaagaaggcataggacctgcatgcatggcaagtcttaaatacatggaattgaaatcgtcatagcttggaatcgtaagccatccgtcccaagcccgccggatctcgttcgccaactcttaggagttgtttaggagttgagaccagaaccgccggggttctttggtgggtcccggcgaatttggccggttgctctgattgatcgattgaagctgggcgagatgattttcaagcctgttcacatttcttgatgcgaatttgtcatagaatacctaggaacaaagcatttgtcagaagtaatctagtaaacgccactgaagttatctgcggtgcatgacgaattgaccctgtttctgtctcaccatatcctgcctccacgatatcaccaattatgcaggccctctccggagcattatacttcattgcatacccccaaatgatttgtatgcccgcatccaacacatccgtattctataacaggtcccatccaatactgagtgtcaataaatgtagccttctgctatgggtatttaggggtgcagcgtctccctccgatgtgagactcgtgtgctgctgtgaccttgttgccagtggcgcttctttacaaaaaacgggccgcgacagtcagaaagtgtagcgagtctaattattgcgatcttccctcagaacaaaatctgatacctcgttaacaccccattatcctaatcagaaaccactcgaaacgcatcctaagcgtacttatagcccgcccaaggggaatcagttgaggaaaggcttggatagctgtgtccacatcagccataggatgatcaaagcaagcagctatttcatcttctcctccttttcccggggattagtctctagctatccctgcacgtattatggtagaaataactatgtaatggctgtggagactcggactcgggggtgaatggttttactccgggggctaatattgtgcaccgctcatgtagacaacatctcggagggtttttagtaacacgttgtttttggtagatgaattgcccataattgagcactaccaaggttatgggcacattggcaaagtaacttccgactcacagatcatgaacagcctgacaccggaggctttttttccccatcttatgacaaaataaaaaaatttctctctcactgctaggcacagctttacttcagatttccttgtaccgaaacccacgcaccgaagaaatgacaacaagtttgggtaaccctatccgcggcctgatgctgacagaaggcgtcttgaagctaatcggcggcttcatctttatccattcacctcagaagattctctcattagcaatgtctcgaccgttcccctcttcatcattgcttctggtgcgaatgctcggaacccagacggcgacgttgggcgcctgcttgctgctggcttcgacaaaaagctcaacagctgttgcaagtcggcgaactgcatattggactgttttcataagagatgccactttggttgctgtacttggctggcaactgctgtttggggatgttggccaacctctcggtttgacgagaaagggtttgcagacttggatcgcggaagtttcccccttcatgatagggcatctttgggtactgttgaggtgtccacaatggttttaaacgacagggttcataggaatcggtcgcattgttgcgattggatgaggctcaaggctgaaatcatcgtcaatctttgcgtatagaattcaccttgaggccacttaaggcagctcaaaatcacagccagcattaccacaaaacatttgtatttatttcgcagggaacacttgctagatggccgtctataaggtgctcataaagtaaaattttgtcttgttgagataaggtcactactaaggcgccgtctgcgcactatttatggttgactcggatagggcaagagagcgcacgtgggtatttagaaacacgagagggatggtaccatttagaaaacgaaagctatggaattctaatctgaccccgggaaacattcatccatcatatggcaaccaggagccgtttccatagcttgcagctcaagtctgcgttgaactctgatttactgagggacaaggctcagtttaccagtcttgatgtcaaacacgtagccacggacatgagccttcagttcctccctaacaaggggggattcttgcaagagctttatatcctcccggactacccgattatggctacattggcgttcagtgattagtctcaatcttttacataaaaagaattacagggatgacttacttctccagatcaccgcctatgtaggttccaaagtcgaactgatcgatttcatcggccatttgagggtacttggactttaaactctcgcgaacatctgcggttgtaatgacagtgcatccgcagtctataaaggttggttattatggtgatatggcacatgatattcgatattaggtaataacagcggcttactggtgtgatggataatgatgacctctttcaaggcctggctctttgtaacttcctcaagaaacagaagcgcgtgaagcccgctcttgacacggccgcccagatttcgaatgactaaagcttctgtcatgaacattgttgtcagcgctgtagttactcagaatgcggctgtggtatgcatcatgttcttaccatccggcttcaggtcgagaaattcctcaacagatgcacggaagtcgaggcatgcaactagagaggcgcgatgttagctgatgcgatcaacactggcgtgcgagatacggacatatgatgacagagggtattgccacagggccctctcccatgaacgtcttcggctgatgcttcgtctcagcatagactctatccagtagatcagcaaaagtcgaggtggatattaaaagaaagatgagcgaaccggtttctctcaaggagctcattccacttggaagccatgttgttcaagaagatagttgaagatcaacttcgcgggtagatgaatggacagagaagggataagaactgctgtgaagttgggatgatgagaggtttgaattgatgggcaactcgggtgcaggctacccttttataatgcaaaacatacctgacgaccaaggtgttgtcctttgagcagacatgctttcatgtaagcaagcccacccttaacccaaattggcatttgctgcaacatcctaatcgagaatgggtgacgctacaatcactcgaactagataacacagccggtcaagacttccaccgagcgtagcacatgttagagggggtgtgaagtggctggatttctaatattacatcatttctgaagattctatgtttataatggccccgaaaatacggtcatacttccttcttcttagccagttccaaaaatttggccaatttccaggattccaccagtctcccagtacctacggactctttgaagtcagagtgggtggcgatggtcgcatctgctgtcatcgccttttgtgagattaaaaacgccgcgcggccatgcttcccagctacggaaacctggatctccttcaactcggcggcatggctttgcacttcctcctcgaggaactctcgctcgttgggcgagatgcatagtagcatgcgagtagtgaggatatggagaacaatagctattgcaagcagttcatagcgcttgccggtctcatcatttgccgtgagacagacgtccacggcgttcagaagtgctgtgttgaagctacggcgccaagcaatgatggcagatcggagggaacgcaatttcgttaccccagcttgaagttcagctgtctgtaggcacgtatccgctgataaaaattggaacgtcatcagcgcaagagccgggatcctggtaatgaaggtcatgagggtcacgccgaggcgagacctatcggagaatgtatcttgtgtaataacagcactttcgagaaccctaatccattcagggttgtcaaggaagcactcttgagatgtaaataatgcttcgatacactaaaaccatggcgctttagtttgtcatgaaaacttctcgacgtgggtgtgagtgattgctgcttactattgggtacaccaacgcggttatcaacgacttgtcgaactcagaagtaaatccagatggccctcttgcttgtatgagttgtgaagctccagaaatatgtcgactccacatgtgccctgtggtgggattcaacacctgccaaaaatgagcgcctttgagaaggataaggggttaagtgttcggtaagtgtgtttcatacctcaaagattgctaatagtcctattgcacacagtgtctctgcagtgtatctattcatctcgtcgtctatggcacattgaaggctacgcagagctttcccataatctttcattatcagatcatcacttgtcttacgagatggagcgagggtcgaatgcgcaacggtgcgaagacattgaaatgcattatggagcgcctcagtttgtccaacgcgtgatgggatgaacgagaagtaggactgttgtcggcagaccagtaggttcgatagagttgactctgttcgaagtatggtcgatgctctaacaccatccgagattagcctccggtttgcttcagagtttcccatagataatgaaaaattaaacagtattcagagtaagtagccatacctgattcccagatgaatcgaggtcaatgcagaaaggtcgataggatccagcccgtactccccaattttggtaacttctagggcgaaggtcgggatggggtgatagaggcagtgatgcatgtctatacctggaccctcagtggggagtttgacgtcagcttgattctgtcttcgacgacttgcgcacgtggccttcattgcatggcttcgaatcctggaccgaacgtcatcccgttgcttccccttaggctggtaggcaatgaaatcaaacccgctggctccgcactcctccatggtcactggttcactgtgagatgcgtacaaacaaccacaatgtcctgggcaagatccacgttggttcagcagtgcaggagtggagttgacctggttcgtaaaatgtcagacagggacacctttgaattactaatgctctaataccgtctgggcaagatgcccactttggcagttgctgtccgaaagcggcagttgctcgcttacactccttcccttcgatatggcactaaagccatcgttatgaggctaataattaagccaattaatcctctgctatcgtagtgattaaaaggaaaagtatctctaatccatacataatatcgacactctctgaacccatcctcagccatggccacatcgagcaggccaggctttcttcataagaatgactcttccaagtaaagttggttctattggttcaagcgccggatggcccatggttggctggagcttcggctcaccctgccggcctcggtttatgtaatcccagtcttttgaactaccctagacaaggcttgcatcaataccatgaaatctctctgacaactcagagatcacagatcgcatactaaatcttgttcttaagtgatgggatactgatttaatgtacaattttggaacttgttaggagcaagttggtttgttttattgcctagatgtaagttgggatacatatgttgacacaaccctgtaagtttatatcgacgcagccattgggacaccaatgcaggcgcgaagttttgccctctcttggctacatagttctggaaatatgactcacaagctccagataaacatgagtttctcatcttgagactgacggtgccatgctgcgccggcttaccacatataatagcacattctagggttttaagagcacaaaggcatcgagcccctgttctaaaaatgggagctgtggagttactaaaaacagcgtgtgattacccctgcttaagctcaattaatgctgtcagccgtatcagagcggcgattggaggagcacagatatcatcatctgcccttcccagctcttacctttcttttcctttgtttcttttcctcagattgagctgacctgcccggtgcactatcgccatttccttcaattcgcttcttcgacacctttttcttcacaagagaccttcgagccggactcgaggacttattttctcccttgacctcacactacagctgaaaccacacagcagacgaacgcgaccgtcgcattcctcgaaaagtctcattgcgcgtcagcctccgccggacgtttgcattaggtgatccattcgcttggccaacacctatcgtcatttataaatcgatttctacaatttttcattttgccgcccgtttataattcccttcctcgtcgacactaaagaacactcaaagcgagaacgagcagaacacccagagacctctgcctcacccacgacaagagcgaagcaccacgactgcaaagaacccagagcctattcctcttaattcagcccgccatgcttctatctattccacaagctgcattccttccttcgggcgcattaatggacaagcgcgttttcctttaccgccgatccgaggcgacagctgccagctcacgatcccaccatcgaacgcattctcgatcacaccctgcttctttggtggatatcttccgggaggatgctgaggatattgtcgacaagcgactccgtgttttacaatctgcttgggtataggacatattgtctgagcgtatggaggaggggtggactgaattgatgtccccggatttgttgtcgtcccgcgaggccaggccacgcttttcagctgcggaaatgcagaaaccgattttgtatatacttttttaatttcttcttttaatgatgaggtctatttcacaaaattatgtcgtctctcggtagatgtccctccatggtattagttttattcacagcttcttcccgaattgttccctcactcctcctcctctttcccgtaaatggtatccatgcaagcagcgacgaacagaagagcatagacaaccgcggttacgatattgataatcgctatagccatcgcggagggcttctttttaggccactgcgactggcacaagtcttgccaattcatatagaccaacgttgtactgggcgtacggttgcaacggcgatcaatgttcgagatggaggtccactgcaggtacgcaacaacgacgcaggcgagtgccagaacgagagagaggccgagttggccaaggggcaggatcccattgagaacaccagggccgggcctgcccttcaagacgaagatgaaggccatgacttcgataaaaccccatcctatagcgattgcaggctaccgagcagatgttagatgccatcgtgagtcaaattcaaataaattgagacgtacaaccgggaacgaaaatatgaccgaagacgaaattacgtctctgttaggaattaggctaaaaatcagacctagagaggagatagacaacagtatcgcaagtacgtgcaaaatcaatttcgaataggcccaggctttactttccataaaggctggtgtgtgtatttgttcgaggtgagggtcaatctcccgctcgtagtcaccccaatcgtgttggtagggctggccgccatggtcgggtacaccatttcggttcaccgactgagcattagggatgagagagattaggggaatcccaaacttggaggcctcgttttgggggccatggttgccatactcgtgataggtctggtacactgggccgtgggaatcaagggctctcctgccggcctcaattccagagacaggcacatgagttgcggttggggtaggatgaacaggagcgttttcctcgtagccatcactttgatgaagttcatctcgcgtagtagatgtttgagaagaggcacgaggtatctgcttgatagacgcctcgggttgcgaggaaggaccaccttcctcgtctctaattatggcgcgccttcgctgagccggagtaagacgaccgaactgtgcatttggggcttcttttttgttatttggtgggttggactttgagtctgtgtatgcctgtgtctcggacatctcatcatcggtcggctcagcccgtgtggaggagccacccagttcgtcgttgcggtggccgggactctgatgagtgtggctatgaagattcacccctccttccatgttcgggtatgttggaatgtaattacgcagcaggatgttgttcgagtgctgtgagatgcgtccgggatgagaaatttcatggatccgagctctctatccattcttttgcgctggctaggtgactggagccatatctaaatcaaggaacggatgcgaggttgaagtaatagccaaaaacactgacggaaaatcaaggttgaaaatatgcggttctgtcatgtgggaatataggcagcaacagacagattccgaaccctgtcactttacctgggtgaccaaagtccgcatgactccgtcctaaatctgtatgcgagaagataagttgactcatttagggcagatacttggtgagttttaacgcctagaaaggattagaacatattaggagaagccgttctgattggtatgccaagaggctgccaccgcatcacatacggacaggggaggaatcacaccttctgttttagtcacatagcattttatctctcgcgaagatgatagaacgggaagcttttgtgcgaatgaaggggctatgagtcaccaacattgtgaatcaagtcgttctgtgatgtttctgccttgatgctttagcctgtctaggtcgtcatgttagatatacaccggatgccaaaaacgcgaccatatcagattgtaagaggagatggcctttaataattaccgagacaaaggtctttagtagaatactcttggcccgctgctcactggtttcagcaaatacgtctgattgatgccatggatctataagttcaagttggagcggatcaacaacaacattgtacattacataaagcaagacggaatggctatgagaaaaacaatagagcagctcttaattagttcatgatgattttagttcatgacgattgaaatagtcgcaagcgatggcggaaaattcccttaacagcctggcctctcataggcccttcaacacttattttaagctactcatctagaatcaagaattcaacactatgagacaagttcatcctagcagaacatagaggtggcttgctttgttatgttacataatgcatcttgtcaagcaacttcttaacaggaggaatgcccagaacccaggtccatcctgcaagcatttgaagaactttctgcccttcactcgaaggatccttcgagcctagaagtctcatagcgtattgaagtggcgtctcaccagcgttgtttcttgcattgaggtctgcgccacgttccagtaaaagttgaataaccgacggataacgggtattcacagctgccacatgaagtgccgtattccctcgcgcgttaccaattgaaaggctagcaccttggtcaagaaggtgagctgtgaaatctaagacttcatgttcatcccaacaagaaactttgaaccaacaaagccaagtgtgcagagcagttgccttgtactcgttgtactgatttatgttttcgacctcggatgcgagatatttaacgggccatggacaccacttcgaagagatgatgtcaaggataaatctttgcagcattgtctctctggcagccatctggttgacgtcaagcccgtgttttatcagtatccggagcatttcgatgctataacaaacaaactgccattctctgcaatttggtatttgaccaactcgaagaggaccagacaagccaagaatgtagtctgcaagcatgacattctcgtaccagatgcaactagatagacacggctttatcttttcgaaagtcaatgagagatcattgttggttatccgccgaacatgatcgatcaacagctgagcctcctgtacggctatgcccctgtcgtcttgaaggggtatttccgtcaatgtatccaagataaatctctccgtcaatagcctggtgggataaagactcaacagctttcgaaaaattgctatagcgccatgttggatcgcctgcttgaagaggtcacccagatgaccgggtgcaccctcaaaagcttcattgatgatgcctctttccatgaatatttccagaatgtctagacgatcgtgtcttacagcagcccaatttgcgtttgagataaatccgacgttgggtctcagtgttaggatccctttcacaacggtacagctggcttctgcgtcggagcaataaatcgcgtattgtagagatgtaactgcacgaaggtaagggtttgccccgtggtccagaaaccagcgtgctagaccccagttacccatttggcaggcatagtcaagcactgacatattaccaggacaggtcttttggaagtccagtccttggattcggatgatatcattaattagtggtgggtaacctgatgccactgccgcaaagatcgggctgtttggtgttatcccagcctttagttcatcgataactggctgcagtctcaacatgctccgtgcgagattgtattttttgcacttgatggcataccggacatgagaagaattatatacctttggtgtaaaaaagaagattgcctttaatgtccactgggactcatgctcgatagcccatttgagggcaggacagtgaacacctcggtggatgttgcagaagcgccccttccagttgtaatggcaaggaatgttggtcattcgctcattgaactcgtagagaagccttatggcggggcggtaaaatcgtttgcaggtgagcgatagggataatagatcccgtgcggtaggaataaccaggtcttcggagacgtgttcagcaatttggtgtatcagttcggcgggcagcatttgtaggtagttctcccggcagccaacgtcagtgccgggtaatgccacctcgatgtccgaagacgatggcatgatttgaatgagattttgagagttgaaggtgtttgagttgaatgaactttttctgatgtgtagcttgttgaaaagcgttcttctctcagacggcgaggactggagagggtacgcctatttatgcaattttttgttggttcccgaaattaaaatttctatcgtactacctttggataggcactggtttgcatgtggacaagcacgggcctgctaggggatatgcaccgtactgccatggaatgggcattgtcctaccatcggagtggcaccgccctgccatccgatgggcggtcgcacgggggtaccatggtagtgcctcaccttaccaacacctgttatcattcactcacactgttgttatcatggcgttccagttctgcagacttgatgttgtctttgcttgtgactggtgcgaggcacaggcttggtcgatgctcgagacttgggcttacgtatgatgacgaaggcaagcgaaccgcgaagtgaatttgtgacctttcgcaagcatgaggcgggcttttcagttaggactaggcaggattttgaggctctagacgggagtcatgccgacgagagaatcaccatgccaggaaaatgctattattagccttaagtgttatacaaagccggacaaaatgttacactttggtgtgttcactgtgttgtgatgctgggaatagtatcaattgtcgatttcttggtgttcgggaattgccccatctatgttttcccacagtcgccatacaacctgcatagctctctcacttattaatgttgccatggccatttaaatcatcaattcgatttcattttattttatggaatgttgcgagcatctcaaacaacttcggcctttgcccattactctttgttttctaacaaagaggctaactgaggctaaaggcagggagagcttgagtgtaaagttaaaaacaacaatagaagatcccagaacatgacatctcgacacaatgaataccaaagtgtttgaatgaatcaaagtctttactgtccaagatgtagtcatgtggaaggaaaagtccgtagaccttcataccgatgacttacttgctgccagggcgagccgctcttcgaatgattatttaagctacccttcggagagagttttgatagaaagttaaaacaaaagaagatgtcagacccaaaatttcacctggcttcattcgtacacgaaaagaacaagtagggcagcatgacaaagagaggaagcgatcagatgcaatagaaatcttttttaccatagagtcatttaacttaggggcatttattctagaaagattgtatggttgggtcctataatgcgactgaaaaaagaaaaagcaagcatacagagcttttacatctctattccaccaaatagacttccttgcccggaatcaacacccagaaaactggcagagttatcctgccataaactgttccccatctcaaagaatgctgcaccattgaagtcccaggcattgggggaagactgaggctcgtcatccagactgatgcttattctgttgtagttttgaaccgtgcggtggtctaaagttcctagcgaccccgtagatgcaacgcatgggacattttccagcttacggactaagaacaagctgtactccagataaagggatgcccaagaggtgcttggtagcttatttgcaattctgccaaagtgctctgcgaggttccggaccagtgtcgaggcttgctcttgcgcttcttgcgagatcgtagggcattttaaagacttctctatcttagccaaggtgttattctgggacaaatttttgggatactcaccctgataacttctgttgctgcatgggatatcatgacgaatggggtattatgatagcctgatgccagagagctgagccttgcgtcatgtacgaatagacggataatctcgcagctaatgttaaagatgtcatggagaacgttattgatcttatcctgcgaagcatttagctttactaagtgcttgtatgtgttgtttcgaattagtaagaggccgtggttgacttcgaaagtaaacacagcggcgaacattgattccaattgtgtgccgtcttgccgggaatagctcgtcccctttagctcttcaagccttgatgatgcactcttatcccactcagcaatagaactgagagttttctgcattccgaaaagtcgctccaaggcttgcaactacaatatcccagtgagtaaagcggagaagaaattgtagggcggtatgcctaccaagttgatgcgtagctgaacaatcccagtaatagcaagatcgccagctgcgctgccagtggcacgagcccaagcatacaattccggctgcatctctctccaggaaacacagggtgcgcgacctatggtgatgccgaaacttttgtccatgaggaaaacaaaaatccacgttctctcgtagttgcggacctgacgatcacggatgctggcgtacatgtttctattagacgcgttgaagttattgacctttttctgaatgaacgaagagtcattgattttcagttcgcgagcaatcgacaaggcctagatgtaataacgaacattttgtcctgctattagaaacccgaaacacattgagtagcttgtcagggggacttacatgaccgaagcgcagccaagaaggatcatcagcgtaattctgagcggcatggctccagaaagtaaacatgataatggcctgaataatctcaaccgtcttcaccgagtttagaattgaccactttatgtttcgttcagccatattatagagtagaggtgcgagtaaaatgtctcgatgacttatcgagagctcacatcctagagcacagatgacggagaataacgtgaatgagcagccgtgtacatattctgccgtgtgtaaatctggatcaagaatgcccacggaagggtggcggattttgaaatacaacttgaagtattgcaaaacttcttgttcattgacaagacctgcagaaacagggtcgcaaacttcgggatttagtcgacaaaagctgtctggaggtattccagtcatcacgtcccagtccctcaaatcaagttccctaggggctgaaaggcaagagttagcgctggccttttaccgtaggtcgttaagccctgcccaatgtttagtttggtaactgcaaagtactgaccaaaatactttgccaacttgctatccgctatcattgcggcacgatctttttgaaactggcctgaaattgatgactgcgaaagaggctcaggaaaccgaggtggcggcactggcctccctgcccaacctttgctagttgatccagggggaaatctctccactccaacggctgctgctaatatcaagagcggagagcattgagattcagcaagatcggtttcagataaatcgtcactggcaactgtcgggaaaatgtcactctggtcactagccctgtgccgatgggatgttgaataggtgccgcgcctggaattatcggagtctgggtgctctgaatacaactgtgagcagttctccaggggtggagtcgatatgttctcgtctcctattatgtcgtcgctggtttgccgagaaggatctggatcagtagggactctccagggtcctgtctgtggctctagattgattgagtcggtttcatcacgcgcctcgcgactttgttctgcctcaattgcagcctttagattttctttcaggagcggatctgaaatacgggataaaagatgttttaatccgagcggcttgctaatataaagcatcgttatgtcaaacttcaacagttatcgtatcaagcgaatatcactcacttcactcttccaggtttgcggccgcgattagatttactggggtacgagcaagccgttccgtaaaccttacagcgggagcttgtttagctttgtgagccccagggcctatccatgcagacaaaaaaggtgcttgttgcttcctattggccacataccagggctgctggcgatcacacttttgccttgcattgcgacaggagtagcaggctgtggccggcatttccgttattgggctggactgagagttcccctgcgagggcttcctggtctgggcttgtcgccgcattgtgactaattgagtttcggatactcgaccaaatgtgatgctggtgagttgaaggggagcaagcggagggttaaagcccgcggggaagtgaagagacgcagatatcggaagaggaaatcccgccttgtctggcgcttagataggaggtgggctctctctttcatcgctggtactgcaaagcactccggctacattggtcagcagactcctcagtccacatttctcctagtttcggaggttcgaataacgttagcgttcgctataaacggtatctaataaacacatgtttatgtgcaggtttagccttgtggtacactcagagatccacgagttggccaagccagagtgtcagatactaaatgcgtttgacagaacaaataagggagatacaacagtggtaaataccgaagttgaccagcgtttggatagactgataagtaattttctggatgtttaatgcactctgggaggtttaagaattacggaccatttccttatcgagtactttgaccagcctgcctcaagctcagggatctccccacaatttatgcgagcaaggtctggtgaccagaaaaaaaatccaagtagattgaatactgtattacgtaggaaatggcaacatcattcaagctgttatgtttggatcgcttgtggttgggcccccacagaatcaagattccgcggcgttcaacttggacaccgcggtgtcttaccccttgaggtgcttcgacccgacacgatttctccccgacctgttaatccttcagtcaaacaactataaagggctatcaatcttgaatgagaaggaagctcccgagatagtgatttcaaatacgcttatcgtttcaacgtcacaccgatccctcaagctaggaattcacgatggctggccgcacgctgcttactaggctcgatgagctctgcaatgtcgatgtcgacgatgctgacatcgaattcatcaagagtcttccatttaagccatacaaccgtgagcttcttacgccataattcaatcgaggacctcagctgacaagcggaagaaacatcaaatcaggctattataacacaggccataacctccgcaacaaacagaccaattctaagtgattgtatcaagaagtacggctcccaaggttgggagactgtctttgagagagtggtaagacaatattcatgtgaactgttgcatctgaagctttcctgacgcaggaatagtccgttcgcatctgtgcaaataacgtccctctcatcaaaggtcgcgtcttgatccaaacgtcgcctaggcacattcacgacgatgtggcaataatcgaccagtgccggcgtttcgcggcggcttttgaagaagccgatgttcccagggatagatttgcgatcaaggtccctttcactggctcgggcgccgtagcttccagaactttgaatgccgaaggaatcaggactttagccacggcggtgttttgtctggagcaagccattgctgcaagtcaatccgggtgtcttctgatcagcccatacttcaatggtacttagttcacaatcctatttcaaatcttcttggatggcttgaaattgacgtgccgcagaaatcgcagcacattttgacccggcactgcgaccaaacgtggcggatacggcactccaggtatgatactagtgatgatcgagagaatctgtgccaagctaatattagcatccaagcatcctatgtcgcctcggattattcaaatgctggaagctttcaagaccttttacacagaaaccggcgaggaacagccaatcatggtcattgcaaggtcagtcacgtatagcacgattcgagtgaggatgctaagtgtttcagccacctttctccggaggaggtgttagcaatggcagagctcggctgccagcatgttacagtgtcgcaggataattatcgacaattgatagcgtcgcctgatgaaagtcctgcaactactcattctaagcccacccacccttatgccggtctgtcgacccctgagagacttcaatcactggcgcagaaagatccgttatcagcagcagaaaagaatggcttagtagcatcattggataccgattatgttgcgcagaatgggaaaatactggacgcagccattgaaagagattccgtggctggaaaacggatgaacgatgcaatgaaattctttaccgagtgggaggaaaaggccaagcaaattatcgaagatgagatttccaagctccgtctgacataggacatcagggtaggaagctgtggatgtgtatgtaaacgttgaactctaccatccctttcacgtttgttgagagccacaacgtagtaccttgctcgtctggcttatccaactttctgttgttgaacataaatgattgcaaaatagtaagcattatcagggcgtctttctccagtctatgaattcctaaatctcagcccctgcggatgtctcggagtcctcgtcgtacacgactacgcggatgtagtcaagcaagaagacagtaggtcccgctaacttcgtcctcccccggagagcgtgcacaccattcaccataggctcgttcggtatcctagacacaactcgtcggagtgagggaatcttgaggccactcatatccttgacgtcgaagcagtagtgtgacgctggcgccttgaatgcagttggtgcgtagtctactctgcgtagcatcaagttttcgtcaaagtagaagagttggatcttgctatgcgccaagtgatgatccggaaaagtgacctcgagaacgcgccatgtctcaccattctcctcgtgcgagtcaacctctcggtattcaaaaccaggctcaaggaggtggaatggaaaggtcaagtagttatgcaaggcataaccagcgaaacatgtgaggtctagatcatcccatggcgttgtccgggtgtgatcaagaaaattcgcatagggattgtctctcgaggctagcacagtgccatctcgacgctcgatccatgtgcgtttgggagtatagatccatttatcatcttggttcccagatccaagtccttgaaacacaacttttgtgtctcggacattgacgtgacatgtaggttgaagacgccccggataccctttccattcaagcgctgatccggtgagattgagggacacctcaatatgtctgaccttgttccagcgatctattccaccatgagcctgaataaccaaagctgctaggtccagactgtcatcaactgttagcattgagatgatcctcgacatttaagttttctcaccttcctcctgtcggcgttttaccattaccagagcttgacatcgttataactttgcaaacagatctatcagagcaccaaataatgcaacagattctaacaggagcgaagaaaatcacacgaaggtgatataaaattcttaaataagccctcaccatgagcattataacatccatcggagctaatttatcatctcacttcatcatggcggtggactaatgtaattaataatactgttcatagatagtacccacaataagacggcttgtttacatactacacctgtttatatttgtgcagataaccgatgtgatttataatgtctccggtgactgattgttgcatgccagggtcaaagtaattcttcccgatgcacagcactatctgcttcgttaactcattgaagtgtgtttctaaatttttatcaatgaccgctatatgatctaatttatcctccgcctctgatgatctaaaccttatactccgtctctccgccatttacctcaacctccgctcgaccattaacctcaaccttctcttggccattgatttcaacattctcttcgccattcattgcaatcttctgtttgccgtttactacaccattaatgtcaaccctcctcttaccgttcaattcaaccttacaatgtgtttctttgactccctccaccttggtttgccactctcttgtccgttcctcatctataccacgaataagaacggctcggtatcgaatttgtccttcccttagctgctgcatggcagtttcgatgccgcatgcgtcaagtgggaacgtcataatggtcggttttatgtttttgcgagcagcaaagtccagcaaggtgcgaatgctgtgcctcgaagccaccagcgagccctggatcttgactcctttccataccaaatcaagaagggggatcggtacaggctcaaacgctaccgtcaatgggtagatactgccgtgagtgtccattagcgggatgagactatgctagaggttagtaatgcaaattgaatgataagtacgtgatgtaggagtggttacctcagatagtcgacagaagcgctgccgcacaagagtagatgctttaggggtttgaaatccacaggaggcttgtcaccgcatcggaagacgtggtactcgctggcaccgtagtccatagcctcctggcgcttcgcttccgagctggatagtactacaacttcgcatcccatggcagcagcaagcttgatagcgaggtgcccgagtcccccaatccccatgaccccaactctctgggttgggagcacgccatactcgctcaagacagtccacacggtagctcccgcgcacatcagcggcgccgcatatacagacttgtagccatctggaattttgtacacgcactttgcgtcccaaactgcgttgtggctaaaggtcccgttgtcaaggtcgtggaagccatactgtttctggttcctgcagtactggtcccaacctggaaaaattattcaataccgagccggttgggtgattgtagtaaaagagaggtcatacctgtggcgcaattatcgcaaactccacatatctcgtgggtgtatccaaagccaacacgatcgccacgctggacggattgcacacaactcccgacttggcgaacaatgcctattccttcgtgccccaacacctgaccgcacttgagataatgctcgtcggtaccgcaaagcccggaatgcgtggtctcgatgaaaacttcgtgatcttggagaactcgagtgactttagcttgggagatcttgccctctggccctccccgaaagacagtgtacgtgacctccattttgagacgtgtaataagttcttgatcttggtctctctcgggctcagtcactactggcaaatggcagtatatttatgttcctccatactatgtccttgctccgtactagtggggagattctcgggaacgatgaatgttgtacatggattacctgcttccaaattggcctatcgaggctacgatctgtatcaaagtggagagctcagtagatggataggtcggcagtgcagactagaggaggaatgaagcagtctggtgatttatgtcagcgacaggagatgattcgtggcgtgtcagcaaggtccggaggcatcgcgatacccagggaatcccggaatgaggctccaagtggcccaatgcaaggccatccgaagcttggggctgacacaaggagatccacgtgcggcctgattggggcagaagctgtctcttcttagctcacagcctctgatggctccacgcaacgtaaagttctcgaacgatcaaggtaacatgacaagatacgcgtgcttcatctcattggacgccatgtgctattttggccccctttattgcttccatcccagtcgaagaatatcagtcagatatccacaaaacaggggactcctggcgtgcggcttgcgcaatcagctgagcggatgtgtctctgcgtccgcggcctcgcctacgatcccgttaagacggcgcacgggtagatcggtggagcaattctgaaaaatgagtgcgtagtttcccttaagttgtaaccctggtcaacggaacacccccctcaacggaacacccagatgaaaatcgcgatagattcaaaaatcaacacaacaacgtcaattcaatagattttaataagagaagctattcaatttgccactggaagcagagctcttcaaagatataattttctaattcctctggtgcctctatctcatccgggatcgcatcgtatcgcgctgcttgtttggctagctgttcaactgttgagaacttgctattcgggttaggaagcaatcgagtccgttttttcggcctaagcatctcattttgcctctctaattgtgcgattttcactgtattgagtgatatcttcacttgttgttcatcaagacccttgcaaatcgaaaagggatatcgctccgtgaacaagaggtcaggatcagatgaagaagcgacgagaatatccatgatgggccgggttttaagggttatctgcgcagcggcacagatgcgtaaaaggtgatggttttcggtggagatgtaagttggaagtttaggcaatcgagattcaaaatgtcatgcacaaggcgtacgcctgaccgcgcagcagaaggctgatcaggctagtgaaattaagctgaaagctgtggaaagacaaggaattatctggccagcgccggaggtcgagacttgttattataacattcggactgcgcaatttaactacacatttcattattaataatgcaaaaagctctagttattactaagaatattaactactaaaacccgcgatacccatttcgaaatctacgataaatctgaagctagattaactaaacctggcccattgcacacattgtttcatgaaaaattacagttctaattaggtccaggatctcttattactccgaccttaaccaactagctaagagtatccccaaaattgctaggtagtctgatccccttactccacgattccatgatatttaactactccgccactagaccttccgctaaatataatttttttcttcgtttcagttcaactacttgccagatttctcaatatctataagaaggtttcgtatatcctgttctgctggtatcaatccaggcgattcagccgaactcgctattaatagatcagttgcttttaatttaccaccccttaagttattcttcgagttttttactaactctcctgcctctcttttttcatctctcttcgcttttatcccctttctctttctttttctgttctctttattttcctttttacttttaagtagttcaactttctctatttcctttccttctccctctagtactatgctcggatcaggggccaatcctgcttcatttcttactatgtattcgacttgatactgatgtaatagataaggtctctttaggtgcgggttattctctgagtctgaaagcttccgtttcctagtattgattaagtactttgtatcttcttccagtaataccttacccggctccgaagagcgggtatatatattactatttaatagttctgtttctgggacttgatatatattcgtctctgataggcttagtctttgtgattctggtttctctgaaatatcagccttgacttcagtaggctcggtaatagtttggtattctattaaaagtctttgggctaccggactaccggtatttatcaataggtagacttgattaatcttaggataagattaaacccctatattaaccctacctactgtgtttaacccagcctcatagttggaaatatcttcttctcctcgttctttaatcgatactttatcgtaggggtttggatttaatatcgtacttagtatagcatcagaatttcgggtatctaatccgctttggaaagaatatatactcctatcggataagctaagctatactacggagtcgattttgagatttatattgacttggggcgataagactctcaaagtatatatggatttatccccaattaatcgctttctgataccagttccggtattgctcgatatagtttaactctttctatccttctgagccagtatacttactagatatagcgtataccttcccgatttctagcttatagcagtaaattctgttaccgaccgactaaacagattttcttctattagcggatatctattaacaggcagggtaagtctgatagaatcagcttggacggctgcttgttattcaatactgaatatctgtatacttaaatgctctccgtttaactcagtatagtcgcttattggggttcctggtggttgattttctaacgaaccagagctataataaactttctctattaaataagccttagtttcaatataagttgcactatcagattgtgcttaataggtaattaaccgctggcagataggtatagtactatataccttatcttcgctttcaataagcactagtaagggggtatacaaagtatagtaactagtctcttggcctaattgttcgcgatcccctgctttatataaaggcggaggaagtgggtaaatagaggctagccctagtaatttttcgttattttgttcaattatcagttggttattagctataatcttataacctatttcataatcttcctctttaaccactggagcaggggtaactgaagtactgcgaataagcctttgtgatactttataatcttctattatagtatcccctattttattacccagactttctagtaaagtagaggttagctctggcgataattagtaattttgttcaattatcagttggttattagctacaatctcataacccatttcacaatcttcctcttcgactactaggttaggattaactgaggcgctatataacgtgatccaccaccatgtgggccataccactatgtgggccacttttttaaactttataacttctaattatttttacttattaactaagataataaaataagaaattaaaccttttctatacttattttattattttatatctaaaaataatattcttataatagatctttatttaaaagtggggttaattgaataaataacccttttcccctaatctctctttacctcttcctactataacttagaagannnttcctcctctattaatactaaaccatttaaactaatacattttatagatcttatttaggtctacctataggctagctttagaaatatcttagctaggctttactcaactgatcagcttaagagtctcttttagataaaagtgggtcttataaaagctatatatatcagtcgaaggttttagtggttgtaagttgattttttagatttcctatagtaatgaattttgcggaaaatcaaaagtagctcgggaagcagctttagcgggttttagagtagtttttagtcggtagacctataagagaaattagtataattttctggtctctctcataaaaataagattcttttgtactatattttgcactatattaggtccctctagtattaaaactcactgagtaatagcggagttagcagttgagagctgtaagttatagcgaacttccctgctgtgttatagcggtcttaaggcctaatacaccttgaaggctactgtaatttcaataaatctagttctaaattatataggcttactagtaatctaaagtaatctattcttaattaatagtaaaaagtaggatataatatataatactaggggtattcctttatttataatatattacttctcttttattagttttattctaagactaagttttatagcttaatatttagtaagtaaatttcttcttcttttaattatttcctttatattattaataatattataatctatatctaagaaatcttattaatataaggtacttatattattaattaagaaaactagtattaaaataatattctattctaattattttaagtataaaaagatatattatataattaaagtatccttatactataataaatatatttatattagctattcttataataatatagaagtagtattataatatagagttttcctctttccttaagtatatagctttttagtactaacttctatagtaaaatagttagttactaagaaatattatttagatatagagctagcttcttctaaggtagttctttagaaagctttagtaaaagttttatatctttattattaatattagatagtataaaagaagttctagtatttattttatcagggaattagggatctagataaatagaatagggtttattcctaagaggagtttattttagaggagtagtaggctataggtatagtatagtttctagatactatagggattattaaatagactttaattctattagaattttctaatttctttttattttctattaataaaactactatataaactagtagtagttctttagatatttaatagatttctatatattattatttttattataatctttttattttactaaataaaatatttacttatttctaatttctttctttaggattttctctagtttatattcttctttataaactttaattagataatcttagtctagagtattttttaatatctttttaaataataagatataaaaaactagatagatatatattatatctagtagtaaaagtttatagttaatatctaattttttctttaaaattttaaataatctaagttttttataatctaatttattacttagctttataattataatatttttataaaataaatagattttatctcccttttttaaaattaatctctttaatcttattttattataatatttttttattcttttctaaagaaattttagttctattcttattttaatatataataaatataatatttcttttataagtataatagctagtatatctaatctattaaattctaattagttttagaatttagatttataactatagtttatatatattagtaatagttagattaattcttatactaaactattatataagggcccgctaagccgtagcggtcatagcgggctgtagtcactgacccacagtggctgcagccgctattggttagtgattgtaatcgctatcggatagcgatctcaatcgctattggctagcgttggcagggggttattagcgattgtagccagtggctgcaatcgctagaggctagtggttgtaaccgctataagctagtggttgtgatcgctagcagctagtggtcaggatcgctatcagcgatctgaccccactaacttatagtggctataatctctcaaattcaacaatagtaacttatattatatagtttataataatctaattatactacttagaataatactctaattagtttaatcttaatctattctagatcttatttagtataagttatctaactattatatattaataactcttattcagctaattatcttatcttaactactatataataataaagaagatattatagctactatagttccttaagcttaataatactatactcctactattatataacagttggataacttatactgaacaggggtctagagtagatcagggttaaactaatcagagggttattctaagtagtataatcagattattataggctgtataatataagttactattaatatataagtattatagagctagtaataatagatatatagataattatattaataactattctaagagagtattctaatactgaaataaatatatatatataaggagataatatattagatatataatatattactattagtattatatagatagatctgatatattaaagattaagtatatcagcctgttttatataactcttataataataactaaggtatagcttaataatataaggagaatagttttataatataataccctctctttattaggtttattcttaagactatattttatagtctgattagtatattatctaattctctttccttttttctaccttttagtattaatattatatcttccagttatattttaaagctaaaggtactaaagtctgagttatttataatttatagaaatacttttctttttactattttaaataatccttctattatactagtatattcctattataagaactatagtaagtataagtattagacttctctatcggattcttcttactatatagattatatattatatagttaattatattataatatttagagcttatttatataataaatttattatattagagcttattattagtaggctaagtaggagttagatatagtagagaaggagctagaatatattaatataaaagtatattatttatataaataaaagaaaatataacttaataagataatataaatagtttcctataggattaataatatagaggaattagaatagattaagtaaaagaaagtagagaagatagtttaaaagtagattatttctttattttctattcttttatctaagctagtattttcagagattaaaattaatctagtattcctataaaaggatatagagctatcttctttatagtttattagaataagtatttctaatcctagtaatattattaaataagctattaataattctttaagtacttaatagatttctatatattatcttaattagtatatcctttctacttaattaaataaaatatttatttatttctaatttttttccttagaattttctctagtttatatttttctttatagatcttaattaaataatcttagtttaaagtattttttagtatttttttaaataataagatataaaaaactaagtaaatatatattatatctagtagtaaaagtttatagttagtatctgatttttttttaaaaattttaaataatctgagttttttataatctaatttattatttagctttattattataatatttttataaagtaagtagattttattttatttttctaagattaatccctttaatcttattttattataatatttttttattcttttctaaagaaattctaattctatttttattttaatatataataagtataatacttcttttataagtatagcagctaatatatctagtttattaaattctaattaattctagaattcagatttatagctatagtttatatatattagtaatagttagattaattcttatactaaactattagaattagatgaagatagataaaattaatagaagtggcccgctcgcttgtgtggcccgctcgcttgtggattacgttaactacttcgcaagttcggaagtgaaaaatgtacatatattgctacatcgagacatccaacatatccagtaccaatcagcctccgggatcggatgatatgattatcaactacgtacacctcgagtatctctacgcctatgcattcagcggcggctacagtttgtcgctgacaatatcgctactgtgccttcacgtcttgattgtcctcggccaacgctcttctattcttcacagctcatccatggttcagctcacgctgggagagcattggagagctgctcgctatggcgctccggttgagacctcccccaaagagtcgcatggaaaacgtcggcggcggtgtggccactgccagaacttggggggctccggtagctgtccgagatgtaaacagcggcgggaagctagagatggtactgaaagaggatacgggcaacaccactggagctcagcttgaacatcacgcgtatgcagagcttgcgaggccaggggtaaagtacagttgatgttgtacatgggcggaaacaggcgagaggggtgcgtctagggggaaagggcgtaattcttttcttcctcccattcccccaactacgtttaagatgagtactattttcatttctaagaaaattacttttcgtctcttcgtaaagaatgtctattggtaaggtaattgatggttagataaaagcagttgcacttaatagagctcataaagttgagaattttgatctaagacagccggatctgttttcagtctatgaagggtccattgatggcaatggaaattacaatcaaatttattgcctcccatcgtcggcattgagtgaactcgcaaggactcgaaactccctgtctcagaaccacattgagttagacgaccccgacttttcaaccccctttcctcgactttgctccgcttatccctcatgaggcagatctggcttttcaactgtgccgctctcaaaaattccctctagagtgtcttctggtcccatggggaaacagctgggcggcttcacgccgtttgtcccgggcgtagcagtgccattctggaccccatagtatatcacagaattagccaggtccgtcgtgagctcagtagttccccaattctgcggggcgaacatgatactcgagtgtgcttctgacatgagagtgttggggatgtcctcggagcgagtataatgctgcatgccgaggttaatccatgccacaagatcctcttgtatgagggactctccattgaagaaattgtaaaagtccacgagtggtgcctcagggacgttctgattcagagcagcggaggagccgggctcagtatcatggtgacgcgacactgcgaatggctgcttggcaaagttgacggaccgcttaaagaagggagaacgctttgatggaagcacaacattggatagacctgggagaattcggtagcccctaggctgaccccagcggttcgtatgattcttgttgacgatggtgaacatggattgaccgtttgctggcatctcgagcaggccatcatcctcggttgcgatctcactgatgttatagcgcatcatttcaaactcgccccgctccgggaaccaaggttgggtgatattctcaaccacgatgtccgtcttgacgaaggtattagctgtgtcgatgaggtcgaagtcggctttgaaattcataacgtgactgtgcagagtaccagcaatagtctcttgaattcttgggccccatttaccttcatcatcgggtctgaaatagttggcctggacataacctgatgcatgggcatcgacagtaatggttccgtcaacatagaatccgtaatcccagaggtagtcgtagtttccgatggtggcaatcatgcggacaacgagtttggagcctttcgtggactgcatgtacgacttgtctgtgtggcgagttacagggacgccgatatctgtctcaaagatgcaaacattggacggctgtcttagagccgtaatcccgttagtgaagttggagtcgaggtaagtggcgtgatatggacagtcatatccaggaatcagtctgccagcctgaaggccaataccaaagtatcggtccatataggcggtgcctgcttggaaaggattgtttccagcatactgggcaatagcatctatacctgttagtttattctctatacagtgagatgggattctttgacaaaccttgaagtgaaagctcatacatgattctctcgtccttgagcttgatgtcatagaactgaatacccacatccttgtcatatctcatataaaatttccagccaaggtactcgatgtacttgttctccttgtcaatcttatatctcttatcaagagtcagaacagtgggtgctagacggtcttctagttcacggatcgtgcctcgacgatcctttcgcagaaaatcggcgtccttggctggcgcgggcgacttgaacatgtttccagactcccaagcactgcgaaactcctcaactgtctcgtaaacctttaggttatacacaattttgcgtatgtggtagaggctagggtctgtcccggcaatgtcaaagctcacatacaagtccgagggctggtcatacggggccaggccggctcttctccatggcgtccaaatgacaccagtggtgccatctgttgagaaggggttttgcacgtagtaggctgccgtggagcgagggtcgctgctaccgtagtacaccacgtcgatcaggtcggcagtgatatcagcaatttgagacatggccttggcaacagcgctgtcaatggcggccttcctgactttgtcgatgaagcctccattcaacaagacgcttggaccgtttggaccattgtagaagtaatctaaaggctgaagagttgtgttgcaagaaatgggaagtggcccagccttgtggtcatggaaaatttgtcagtgtaaggatttgcctgatgggtctcgcttccacctacaaagtattcggaaacggttggggggctacccgagccgtggtttatgataactcgagcatgtcggggtacgacaccgttgccgtccaaataagacaggacatctgttttattaggcttaagtgtctcgatgtgagcaatataattatcgcttagagacaaggttggacttgagctatttgtaagatttagccccagtgatttgttctccaacagccaggttgccactgaatggatctcagaaggtgtcaaggatgtgaaagggttcttcttgggggccgtaacgggaatatccttgggtgcagggcaagcttcgaggctctgggtcgagcgtctgcctatatcgaaaccaatgccagcatgtacatcccagtctcgggatggactaggagcggcaatagttaggccgatgtatccaatagtgatcgcctggacaggtctgaaacgcatgatgatggttggccgtgcttgaaaagaggaagagatcagaaatgggtgctcttgggggaaattctgtcagttctttgtggcgagaagccgttctttaagtattttgactcagacttctcaagtgtagggccatatagaggctcttcacatgtacatacttcatgatgcgctatatccgatggtcctagcttgccctggttcatcctacatcttgctaactaccttctacataatgccccactagaaagtaataatacggcaagttttgcttgagaacctccagtttcggttggatttagagtaaatcggctccacttcctatcgcacactgcctttccgagttgtgttccgctctgttcgtgacagtgtaagaccagtcaaagattcttccactatcatagaaatccctatcctcaacacttgtcgtttatctctttgaagagattattatgtaaaagaatagatctccctagatagaaggctggggtgtttcctggatcgttgcatccgaactaaaagctgcatggttgacagagaagcgagtttagctacgctagcctgttgtagctacgatatcccggtaaccaatcagagagtctctgcaaatgcaaacagagtggattcagcaagcaagacggatgcggggaaataagagtggcagataaggtggtcaagctcgagtttgatgccactgcttgagtcatttacaaggatatcttcttgattttccaagagaataacatatcttatctcgttgaatctgatgaatctatggatctataggagaagaagccgatggctcagttttcgggcaagctcattgcggacaccgctggttcttatcgagtcttctccaccctctacttcattcgccataccctcggaattccccacacccgaactgtaggttccgagggatggaaggagaagccttcatgaatgttatgctagacagagctcaatcctttcttcccagcaaaattggacccattccatatcctggcccccaaacatccttctaccatcgcagctcttactttccgctggccaaactcgctgttgtaatgctctgattatttcaagaatatttgggaagtgctgtttttcatatagataactgagagaggaagccacggctgctcgcaacgagctcccgccctcactctcgcaccccaatacgaacattggccacagaatcattgtgattgcactacttgtaattggtactcggaaacagagggtgaaaagttccgcgatagcttgtgatacatcacagtcgtccaagcgtgctggagaaacgctttggattccacggtatagaaagatgctggtcgctaggcaatgtgcatgcgcaacatcgatacaggcattgtaattttgagactcgtgatctgtggagtctgggtaagaatatggctggtgaatctttgatgggaggctctccacggcatctctcaaccgtcttagcaactccgtccggcggttatggatttcgttcaactccaaatcgccgttaaagaatgcttctaccaaggcagctgcgtcccccgtaattaacaaacttgtggaagcgaatcctaaaacgaggtctgggcctggcctcatatgctgatgtggtggccatatgtgatggtcccagaaagactggtctgtgataggtttctttgcacaaggtaccgaacacatagcgtcaaaataagccatcatcttgatatgaatagcaaggggcctaggagcatctgaaagatttctgttggcgattgtggagggagatatgcttccgcaagctcgcgtccatctcaattcaaggagagctttgattccattcaaaaacgggagcaaaactttcgggccacccgctatctctagagaagccaatatcatagatgccgcaattttactatcgatatgagaaatttctttttgatggacgagaagcgagtcattcatgatgctgagggctttgctttttcgctcgagaacttccacctggctgattgcacccgaagcagccatgtgtgctgctgaaaatgccaagacgatcgggaggagtaccgaatctcgatcccatacgagagagaggtgttccggcaatatggtttggtactgctgcggacaagggtaagccaggccgggcagcacggtggcccaatggataaagagaggcaggtctgatggtgaatcaaactgtggaccgactttgggaggaggcaagagccgcagcgagttcgaaccccggacagtaacgccagctctcgagtttcccccgggagccacatatatcgaacggttgctgccgggcgttgatgtggtgcgtggagacgtccacttcaaggggtgagcatatccaccacacacaacgtgcctctgacggcattgtgaacagttgggccgtgattcatcgcactttagacgggactcccgacatgtcagacagcctgctcgtcaagattccgattggtcagctcatgaatatctctcgcagtaggccaggtggggtgctgtaggtgacatgtatgatctcaccttttctagaacggcgatgatatccctgtgcaggcatcgtggactagacttatcgacatgtatcttccgatggtccaggacaaagggctgacatcactctaaatgagaatggcaatgataccctggggacagcggcgatacagggtgcatatagccgccaaccttggagtcaccgcactccagatctacagcttatctcttggtcatacgtatcgatgtcatggcccttatcaccacttagtcatggattcccaggttccgggaactctatcggccctgtcggcgacaagtccgttgaaccgctagtgggtcattcatatgggaactgctagtttctattcgcctattctacatgcagcgtggggaaaatgggtgtcggcaattcacgggagcttgcactggtttagttatctttatctttatccttgctaagactcggcctaactcgtgatagcctcaagcttattgtgcaaaacgccctgttgatggttgaggcgaaacattggattaccaaaaaccaaatagttaatatgatcatcaccgttattccagatgtcactctgccaggaacccaggtgctgctcttgacagtcattcgcccttagcgcaagaatccttgatctataaaataccggcatcttgatgcccaaagagaggtcgtactagtacaggtattagagggaaaagagaagatcaagcctaagcattcatgcgacctcttatacaagtgcaagtatcgagacactaagtcatttgttgtttccggctatacattagtcaacctcagacaacccataacggcgctggcctggttgtgcccagaccgagcgtgacacatctgcttctcatcaagggaaataagaccatcggtttttcttgtgtcttcgagcgtctaccacgtcctgcaattggccaattacgttgctttcccatgttagcgagtcgtattatctccctagagatcatagcgctctaaccagagccaatgacaaggtgaatagatgcgtctcatgtctcactccatctccctgaagtcaccaaaaagcaaaacctctctctccgcctactcacgcatcacgcaaggaattagactgctgaccaatttgcttttcttattgatcctcttgataaacatgtctcgtagccacccttgatttctggagctgcttttttctccgtgtcccatcaactttcccgagacctcaaagcgccgactctttgctgctcaaatccctaaatcacatctacattgatcatttgtgttcagaacatgccaggaactgggtgacgagtcattgttggtgtcatctcatccattaccatcaaagagaggaatgctacaccaaatgtccaattgttaagaaaggggatcgcgcctggtgttcccaaaatacacactcatcgtcatggcccgcggcaccttcgtcccgcccaacttcagggtcgacgtcccgagcgaggacgagctcgtcgccgttggtgtggtatggggcctctcgctgcccctcaccgtcttcggcatcttccgctgcgtccggcagacgtacagccagtacaggcggaccaagagggtcaacctgtacatgctcctcatctggctcgagctcatctcgacgaccttgatggggggcaccgcttggggatacgtgcggggggttatcccacccaggtgtgttacatacaaacacatagaatggagatatggctggtactaacacggtatgtgcagcatgtggtactttctcggggcagtcagtaagttcatcccagcctccacgcacagcttaccatggtgacttatgaatctcaagtcatcctctggattgtccagatcaacgccatcctccagatcatcctcaaccgggtcagcctaatctccgacaacaagccctacgtccgtcgggtccagtggttcctcttcggctccgtgctgctgctccaggtcgccgtcgcctgcgtctggatccccgcgcagctccagatctcggacctgtacgtcgacttcaaccacgcgtttgaccgcacagagaaggtcatattcgccctcatagacctgtgtctgaacgtgaactttatccatttggtccggtcgaccctcatcgcgtacgggctgaccaaatacgtcctgctgtatcgtgtcaacatagccatgattctcgtctccatgaccatggacgtaagtacgacccctaccactaactacacaaacctacttaccaagtataatcttcctctcaggttctcatcatcggcatgatgtcgctcccgagcgccttcttgtaagacaatccctcacccgcctgaaatcaaaagctaaccgcccacgcgtaagatacgtgctgttccaccccctagcctacctcatcaagctccacatcgagctgtcaatggcagagctcatcgccaagatcgtcaaggcctcgagcaggagccggagctgcctgtgtccctgcaccgaggccggcaacgacatcctggtggcgcccaccaccggccgcgtttcaggatggggtcccttccggcgtctgcgggagactcgggcggtagatcagaccacggcgacaagtatggtggtcgaaaatgagaatcggactagataaggatgttggatgggttcatataatttgtcacttcgggggacaactacctctatcttctaatgtgcaataagccataactcttcatctcagcattctgtataagcaaggagttgcgaaataattattcaaacgaaaggaagcagacaaaactgagtcaattgaaacttcataaaataacattgattcatcaagacgctctacagcaatatgtgtaacaagcttatctaacaatcccagctaagtgggatattttaacatctctttttttttgttttctttcttttgtttcgtttcttccgttcccatttccgtttggatcatttctcatgtctcccaaaaattaccaatttacagacggctgaagacgccaatgttggcgggggcagcgaggtcgaaccggtcgaggttcatgaccttggcccaggcggcgacgaagtcgttgaccagcttctgctggccgccggcgctggcgtacacctcggccagggcgcggagctcgggctgcgagctgaagatgaggtcgaagcgggtggcggtccacttcttggcgcccgacttgcggtcggtgccctcgaagacgtccttggagtcgtcgacggccttccactcggtggacatgtccagcaggttgacgaagaagtcgttggtcaggacaccagggcgggaggtgaggatgccgtgggacgagccgtcaaagttggtgttgatggcgcggagaccgccgatgaggacggtcagctcgggggcggagagcttgaggaggtgggcgcggtcgacgagggtctgctcctgcttgacacggccagaggacttgccgtagttgcggaagccgtcagcgatgggctggaggtagttgaactgctcgacgtcggtctgctcctgggtggcgtcggcacggccagggatgaagggcacgaccgtgcggataccggcggcgttggcagcgctctctacggcggcggaaccggcgaggacgatgagatcagccagggagatgcgcttgccggtggtctgggattcgttgaaagaggtctggatgcgctcgaggacgctgaggacctcggccaattgctgagggttgttgacctcccagtccttctggggtgacaggcggatgtggccaccgttggcaccaccacgcttgtcgctgccacggaaagtagaggcagaagcccaggcggcggagacgagcttggagatgctgagacccgagttgaggatctcgcgcttgaggctcaggatatcattgccatcaacgagcaggtggttgatagcagggatagggtcttgccagaggagctcctccttgggaacctcagggcccaggtagaggatgcgaggacccatgtcacgatgggtgagcttgaaccaggcgcgggcgaaggcatcgttgaattggtctgggttcttgaggaaatggcgcgagatcttctcgtactcaggatcggctcggagagcaatgtcagtcaccaacattctgggggggtgcttcttggacttgtcgaaggcatcggggatgaagttgtcggcattctttgcgacgaactgtggggcaccgccagggccctcgacgagctcccactcatagccgaacaggtactcgaagaagttgttgctccaccaggtgggagtcttggtccagataacctccagaccagatgtgatggcatcggcaccctttccggacttgtagctgttcttccagcccagaccgttctgctcgatggaagcaccctcgggttcggggccgacatggctgtcgggagcggcgccgtgcgtcttgccaagggtgtgaccaccagcaatcagggcgacggtctcctcgtcgttcatggccatgcgggcaaacgcctcgcggatgtcgtgggcggcagcgacggggtcggcgttggcgttggggccgcggggatcgacgtagatcagacccatgttggtggctcccaggggcttctcgaggctctgggcatgtgccttgccgtacttgttctccagcgaggggccggaggcgaagcgcttgtccctgccctcggggaagaagctggtctcggaaccccagtagacggactcgtcggcctcccaggtgtcggcgcggccaccggcgaagccaaaggtcttgaagcccatggactcgagggcgacgttgccggcgaggatcatcaggtcggcccaggagatcttgttgccatacttttgcttgatgggccacagcaggcggcgggccttgtcgaggttgccgttatcgggccagctggagagaggggcgaatcgttgttgaccctggcaagaaagaaaaaaaaaagtcgggttagctctagctccaatcgatcacatgcaaaccgagggattgcgcgctctctcttacctggccaccgccgcctcggccgtcaaagacacggtaggtaccagccgagtgccaggccatgcggatgaagagaccgccgtagtggccgaaatcggctggccaccaatcctgggaatcggtcatcagggccgtcaggtcggccttgagggcattgtagtcgaggctcttgaactccttggcgtagtcaaagtcggcgccgaagggatccgaggcaactccgttctggcgcaggatgtcgaggcggagcagctcgggccaccagtcgcggttcttggggccgccgccagcgacgttggactgggcgtaggggcacttgctctcactcatggtgacgaggctggtgctaatcgtgcggtgtgggaggaggagaagtcgtcgtggttctggtctccggaggtacgctctgggaatcaatcgtccaaagagaggcatcgacgaaacagaaagcagaggagaagaaacaaagtagcgttaacaatgagctggcaggtcggcggtcttataccgacggcacgatgcttcgattcaggctagggtgggagggagagggacgcaattcaaaagggtaagcaatgccgatgggagaaaagtcggggcatcgtcactgcagcaattgtgtgctgccttgactcaggccaggggaggcggcaggtactggtacaagccccgtctgccccgcacttggaggtttcgcagcgcgcccgatgacaaagcccgcgcagctgttggccggacagtgccgaggcagtctggagccagcgctgggccatcccccatagggcctggacgcgagggcccccacagcagctttggcgggtgaaggcgcgactcttgccagcccaggcgatcgcggcaggtaccggtacgagatggagatcaacggtgacggattgcatcaacgactctgcccaaccccgaatgtccgagtttttcgcttcgaatcttcgttggaaacacagccatcacacattgcactgtctcaattacctaccacgacacccctaactgctacaccgattgaaaacttctcggcttcaatccagcacaaccggctacatccccaggtgcaaacgtcataccacatgacataatcaacaaacagtggaggcaatgcgaagcgacacagagaggacccacctctccgccatctcctgccaacaggccactatttttgccattccgggtctagccccgatgcctgttttccccgtttccagcctagcccgtttctcaattccaaattccaaattccaaattctccaacgctcactttaactccccaatcggggcattacgccagctgagagatttcaaatacctgcgccctgagtgagtctccggcccgccgcctcggatctcccagtatggggaagcccggctttctccggattttcggcaagatacgatgggatagaaaggtcatgtttttctagtcataattcaataggatagaagtgtcatgtttttctagtcgtgatacgtatatgctaggttaatgctgatagagaaataaatatgtccatgaaagtgtaggtatagggtatgcagtgtttaaccccccaggtatacccaagccgaaagaagaagacaaacaaacaacccaaaaaaacaaacgccgatactccgatcattgtatcttgatatcccttctactggagtagcacggtatcctcgtccagcacgccatacagcccctccacctcccgctccatgactcgcagctcgtccgccacccgccccgtcaccaggacgtaggcgtacagcagcgcgtagtccctctcctcgaccgccaccagactagccgtggaggcatcgtcgctgtgacggctgcgctgggacttgacctcgatgccgcggatgctgccgggcctgctgctgctgccgccgcccccgacccctgccatttccgcggagtgcttctttcggaactggaacaccttggtgaggaggttgttccgtagcgcaatgatgttcggaacggcgttggagagcggatactcgagcatggatgagctggcaatcacctggaagatgtggcacatgcggtcgcacagcacggcacgctcgggcgccgtgtacgccagcagcaccttctcgccgggcgtgaggtggccgctgcggtgcgtcaccagcgccatggcgtagaagccgtccagcacgcggcgcatgctcctcatgatgcgcccgtacgcctcgaacgggaagggtccccggagctcaaactcatgcgccgccgactgccgcaggctctccagccgggcggcgtacctcgtcatcgcctcctgctcccccgaccgcagataactacgcgtggcctcgctgtcgagcaggatggcgagggggccacgtctccagatcaggcccatctggagacacagcatcgagaggccctccttgaacttcttccgcgccgagatgggccacatgaccctgcagatgaacagaccccacaggatcccgcacgtcaccgagaggcaacgatgcttgacaatctccagcatgtccggatcgatgccaccctcgtcgtcgccctcttcgacgttgtccagccccgcgctcaagctgtaggcgtacagagtcgagacgttgtacgcgagctgggtcatgcgaccgagtggcgccttgcccgcggccacaatgaggtagaagttccggaaactcacgagccagcccaggaacaccagaatcaccgggttgccctggctgatgttccacgccgccaaagaaagcagagcaccgataatcgttccaacgaatcgcgacgcgcccgtagtgttggaagctccaaccgtcatggagcacacaatcatgaatgacagcagaccccattcgccacgatagtggtggtagtattcgcgcgttctctcgaggaatgccagcatgccccaaagtgaggctcctatgccgaccttcaggccgaatagaactgcttcatgttagaaatgcgagatattaatgcagcgacgaagaaaactcgtcgatccgcttaggaaagtactcactgtcgtcccttgccagcttcctcacaaagcgcagagtcttttgcgaaacaatcgacaacagcttgctcgcgctgggagcggcctcccagctgaaggtgtccctcctgcgcaccatcgagtccgaaatccccctcggcgtagcgtgtttcctaatcggcttgatgagcccttcctcctccagcgaggaaagccgcagcgagctcaggctgcccttgcgccaccagagcatccactcccacgaccgcctcgagtggtcgcccacgtagcgcagatcctccagcgtctccaggtggacctggacatcctcggcaaatgcctgcatactagacgtgaagtgcccgcaggctgctgcgacctgctcgagctcgacctggtgcgctgccgagtcccgggctcggagtgccggatgctcgtacagttgctccagggcgttggttcgcgcgatgctgaacacggcgatgctctcgctcagccggccgctcgcgcgactctgctcgttgccatgctcgaatttcgactcccggaggatgtggcaaatctcttctgtgagcgcgatcattggttccttcagcgatgtgatgaataatgtgaaaaagtcgggagggttgaagacgggctccgtgtcgtccccgtcgtcgctgctgctctcgttattaaagtaaataggtatagtggaaacaggtgacattggcgatggtggagggcgagaaggtgcgccattggggctgaggtaattcgggttgatctggttaattattgggttgagctgtccgtagatgtatgggttatcgaggagaacaaacagcgtgctcgacgcactcctcagagctccgatggactgcgctagtttctccatcgatttaacgagtgccctctcggcgacgtagattgtttcgtggccaaggaggtagtgctcaaacttagcttccctgagattcttcatcatctgggggtaattcgttcggtacgcggaagatgatgccgagtactccgcaagggccgggtcgtcctcggtgccagtcatgaagcctctggtaatcatggccagcatgtctccgagggaagtagatcccttgtccatggtgttgcgcagcagggtccgagcagaaactctccagatgaagagattgaccatggtggtagatgcgatgcccatgaggaggatcttgagcacctggacaatcttctggttggagaagacattgtcaatgacggccgtctccttggtcaggacgctgatgatggcgagggacgcgagggtgctcgcgacgttgaccagcgggttctccatcttctgcttgacccagcccatgaagccgaaggctccgccaaagaacaagacaacgaccaggacgtgggccaaggtgaccatcccccacacggcgccaaacagcacggaggtggccatggacagcaggcagatgacctcggcataggcgatggctacgatggcgatgatgacggcctcgatcatggacccagtggtccgggcggggtggaagtagacggtgatggtggccacgacatgcttgccgccgggcttgccgagcagatgagcgacgggcgtcacaaaggtggccagactggcgatggtgtaggccatggtgcacttgagcacgccgcggccctgcggcgagttgagccagtacagcaggcgcaaggtggtgtccgagaccttggcccggaaccgctccatggccgtgcccgccatcgcggagcggtagaggctgcggttctgtcgatgaggcccggccggggaagtatgtcactgccaacgacgggtccgggaatgcagattggcgattgctctggaagtagccagtggcagagagggagcgtgccacagacgggatttatgaggttgtttgacggcgccaaggcagagggggtggagcttacgccgtctcgtggggggaggcccaggcaaggttataaatagaggtggacatagacgaggatggtttgaagccttggaggtctgtctgtgcctcagctcggcacttccctgtcgagccctgccctaacaatggatgtgtgcccgttcaattgtgatgaggcaagagggctggagacattcaatgacctgatgatggtataactagtgccttcttgcgggtagatagccgctggattgtcacgccgcagcggcaatggtgccgtcagggctcgttagtgtccactgcagccgcttcccacagcgagtgatcagtggtcacagggcctggagcgacccccacacccgctgccactgctgcagctcgcccgcctgtctcacaccaatgaatcatgtgtgtgataacggtaagacactgatcgactgcgaaagcgactgaaagagccatttgggatgcccatcatgggctctgttgattgcgagacccaggcagcttgcaaggacgggcaggcaggcccacacagtgtgttcgttcaccatcctcccaaaggacgcgtggacaggaaatacgcatctaacttccgagcttcaacgcaatcggaacagctacagataaagctcagccttgtctctgtcttctcaaagcccagccacccatccaaaaagtcaatttcaagaaacacctcccagcctgttactatctctgagtctggatacacgcgctgatgaaattcaaagacagtgcttaactcagttttcgcctaccagggcagtgagaaatcccgtccgccctaggagcactgatcatccatccgcgcctttaattttccgatgacatccacggtgtctgattgttgtaaccgaacgcgggccaaatattaataatactgtccgtccctgtctggtatggtcacgcatatgtcaaaagtcccaattgatgcctcagcttgcaagggagctacgagcattttctgtgagcacgtaagatgggtgctgacgccaaaaaaggcgagctcgctgcctattaatttgaccagtcacggttctaagatcgtgcagtattctccacctactgctctagtttggtttagctcaaagccagactaccaaactcaattccagccaatttcgttgctctcttttgcctcggtgtaggagtccttggtggaacacgtctcatgatcaatttgatacgtcatgaatgttaaaaaaaaaagatttgaattatcttatcgaacagaaaagtagtatagacatgcaatatatacttgtatcgtaacagcaaacctgctagatatcagactacgtgaagctcaacggtcggattgcgatatagggtaagctatgccctgagagacccaacaggctccagccacaacgtacgatcaattaattctcgttggatcttccaggctccagcttctcgatttcggaactcgcctctagtgtaggagcgcacaaattttgagtgtcaatgttgcgcaaagaaacatgcaaagggctgctttagcctcatattcaccatgtggtctgatggttggcacgcaaggcagatttcgatgttgtgtgttggtcgagcgagcccctgagccaccttgaccatgcagccaacgcccaacagccatgagagtggtctgagtaataatccaccccatgctcttgtttccatctctcccgctctcccagtcgtctccccttacattattctttgtgtacgtttgttgttgtcagcatgactctcaccaatctcccactagagcttcaatccaaaatatgctcttatcttgtcaaatcaatcggcccttcatccatccatgccttgctcagaacatgcaaacaattatatgttgttgctctccctttctctgtccagatcttccgaaatacagcccctatacacattggtaggggcccttgctccgaaactcgcaatgtgcaatttctacgctatattctcatctccaagcccgagctagctagcaaggttgacacagttatcctaggtggctttacgacaactaggacgagagtgaaaacacccaccgcggctaccagcaccgatgaactcgccatatatcaagagttcatcatcaatgccttgggtccccaactaagtgaagccgacttgacaagaagggacagctggattgctcacctaaaagagggatcttctgatgcccagatatcgttgatcctgctcgcatgttcaggtgtacggagactctacttcgaagattatcaagaaggatcatcccagaaccaacttttcaaaaagccggactgtttcatattcttacttgagatggccaagaccttgacaacatttaacacctctgccttcaacgctccactgcggaaccttcgtcatgtccaagcccaatcccacgaggataacgactgtggctgggaacaggctttcagactcatggcgctgcctcggctgaaatcttacgaatccctcgatacaaccaggcgtggtaacttcgcaggagattcaactattctacctctcatcaccacaccccagtcctcttccgtgcgacacatctctctccaccagtccctcgcgcccgcggcagaagtgcaggctttattgagggtgtgcaagcacttggagaaattcgagtacatcagcccgacttttgaaccgatatccggtatttttgcccgggatatcatggaagccatactcccccacgctggcactctccgtcatttgcacattaatttctccgatgaatgcaagaagatcggctgggaggacgacccccagcggttatatctgggaaccaaacttgtccagatgacggcgctgaggcacctcagcattgggatgcagtctctcacaggcaagtttgacccggcgcctacagacgagcaagacacgccatcacagatcgagggggcccctcggctcatagaatgccttccaaagagtttggtagagctctccattcgtgattgcggcaggggaattctcgaccaagcgaaggagctgatgcaaacaatcgagaagggagagcgcttcaacaatttgagacgtattgtactggttttcaaagccgaaatagtcaacgtcggagacatccggcaagtcatacctgcgaggaccaaggaagagggccggtgtgatctttgggtggctttccagcatcgagaagcgcggtgggtcagctcaggaagaggacatacttttgaaggaatccgcgccatcccgagtctctgttctcgaatattcgcggatgatctgcgcaaggactggattgattttagaggagggcttgcccataaactatattccaacgcttttgggccatgctcgcctgatcatggagtggatgtggatgagagaatgaataggctcttacttcttaagccaccgcacgagtaccagctcgacgattagctgggaaatattgagggcagtgccgtattgttggcgcagcttttgctgtgagagatggcggaaccgcaatgcttcaggtcctggtcatgatggctaagtttaaaattccttcacagagcgctccgtgaccttggcgccgaagtagccaacctcatcgccgagacgcttgtcgaggatcagcacggcccagtcctcctttgcgtcgcagatcccgccgccgatcttggtgctcacaggcgtatgcgtggattgtgacgagttgaagaattccttgttgccgtgtccagggaagaatgtgacggtgcggttgttcaggatgcagtgtttggcagtcaatacgtggcggtggcgacaagagagccgctgcatacgtggactgtgcttcagatgatcttgcctacggcggactagggagcggaatggttgttgtagaggaatcgatcgtcctcgccgaagatgcgtccctagagatgtacggcttcttctccttctatgcttcgcttttgaattcttaaggtctaaatgagttaactatgattttgttagtatcttggcaaaatcaagataatgtaaggcttggcttaagatatatgtctgtttgtctctagaaaggttggactgccttgcaaacgagcggcatatcgtaggctatctaagacccggttcctcgcagagctcgtcgtgtgtaagtctgaaattctggtcgtagacaaagctcgctgaacgaatcgagcacttattgcatgccattgccataggaagctggggtaggacacaaagtgaccagactttttccaaagacccaatcctacataatagcctagagttcaatgcataacatcttgccaaagtacgtttgtgatttaattttcaagtggcgacgtagctccattaggaagaactatggtcagccatgtcgttgaaaataccgttccttctcatcattcaacggcttgatatcaacaccaagacgacgagagatcctctcgacctcgcgctcaaaatcagaataatcatcgtcctccgcggtattaaaccagagtatctgtcgcagccgcggaaaattcgtaggacagctctcggccagcactaatatcacactctgaaaagtgtgagcaggcatccatatgcgcctgctcttcccccaagcctgtaaatcttttccccatcccttcatatcaggcttgcgcgcatcccacattacaaatgtcgggtcatccatcatgtcgtcggttagaataagagtctcgactgaaggcgggatgccgcgacccaaggggggatagttagcattaaagccatacaaggccaccaagggaacatgaagttccttgatccgatcaaattcgacaagattatcgaaagacccagaagtacttagttccggccatgtctcccttcggccgaaaccaactcgaaacttgatatgtagcttctctaatgtatgtttggagggagaaatggcggttattatcttatccaagtttagatctgggtccttccacccgtcgcgagagatatcctcagcgtaatcccaagagtaggtgagtgatttgagattccgtgtcaaggagagtatcttctttagaagccttgggtgaagccactcaatatctaaagaggttaggtggtcgaggtttggctttccctctggccaccaaaacctttcggggtttgcaagccaaagtttggcatctacaagatttggcagataaagagtagagaaagcctcctcgaactgagaatcctgatctgactgatcttgatcttgctcatctttatcaagacgtctaacataagctaaccgctgcagctgtgtaaacctgggaatttgatccgggaaggcgtcgcgtttgggagcgtcattagaatcggattcagaagcctcatcagaattggtatcgagagcctcaccatcagatttgtgagacctagcatcgggttcgagagcctcatcagaatcggactcgacagtctcccaagaatcggattcaagagcctcatcagaattagggccgagagcctcaccatcggatttgtgagacccagcatcgggttcgagagcctcaccattagatttgtgagacctagcatcgggttcgagagcctcaccagaatcggggccgagagcctcaccatcggattcgtgagacctagcatcgggtttgacagcctcatcggattctacagcttcagaatcggattcaataccctcagaatcggaatagacctcacaatcggaatagacctcagagtcggagtcgacctcagaatcggaatcgaccacagaatcggaacgcgggggccggaactggagagccttggatcggaggactttaccaacaaggtgaaagttcctgatgaaattggttgtaatcgtaagactggtcgtgttggagaggtaggcgatgaggagtccagcgaatgcgtccatgtgacgggtctccagcctcgccacccagatgtcggtgtacggtgctttggtcttttcaatggcagaaatgaattgagaaagggaaacgttgcttggcatcgctagccgcaactggtcttgtgacatcctatgccgaggggcatttcccactaaggagaatgtatctataagggcaaaaagctctggtctagagagaagagtccgaagaaggagaatgattggcggcttctcagaagtcgaccatctgaagttgatagtggaataaagacatggctcggcatggcgacgattggaatgattggtgagacataaacttgcgagatcagctttgagtagtaaattgaagatctgttggatgatttcgattggaatatcattaaggagcgccatggttggtttgagaattcaagaaaaggctactcttagtgacaagttaacgaactcgtactcgttgtgcacaacggaggcacagccccgggggggtgatctcgagaagaggggaagcctgcatcgtatctttagtttgtggacccgtggctcttctcattgataattttgacatgggtgaggtgatggttggtggagacacgtgcttgtagatggcgtcaaggtggttggtggagaacctccgcgacaacatttcaatctatcatcaagagaagaagtgcatattgatgtttttgcaatatttggtgttcaaagaagctattttggacacaccggctggactttgaataaagaagaagagtttaatgtcaagttaatatgcggatcctcgtacttcgctcagcaatgactcggaggccaagatagcttcaaacaattcaaaatggtcaagccattggagtgtactggtattgattttaatttgtgtctggtggtagataaagaatgggagcgcagtcttgacatgttgatgttgcgataactcatgccgaaatggtgggctaaagtgttcatacgaggatcaccagaaggaagagtgatgaaatgcctcacataaccgtaccctgcaagttgctccagaattaatactgggtctttgttgtacaagagaccaaacagcgtgggcatgttgtggggtggccctcgctcagttgcgcggcgcgatatcgccaggtgcctcactccacgccagcgtgctatatacttggttatcggaacggtatttcaacaattggggagagtggtctagttggtaacgacatggtcatccaagcgcacccgacccagatttactgatgaagggaatcgctggtaaagcggagggcggtacagcgcctggcgaagcatgccagcccgcctacctctgtacacacaggtgtaaagtagggcaccggggcgggcgccgaccaagacaggggttcgaatcccctcctctccattctttttttcctttttttgcgagtttcaaatccaaatcattgtcgagttggatgcccagccaggacgagtccggccgaccagctcaactcagacagaacagggaagctacctcctctaatgctatggaattaatcatctgaaccgcgtaactgggagattttctttgatttatctgttttccaacctttagaaactggctgcgcatgttctgttgcttcaccaagtattctccccacccggcctggtactccctcttgcatcgaatcattatgaggaactccgcgctaccgcattattgggtggccttgtagacttgagctgcaataactgcctatcactgacctatttgaggcttctatgaagtatttccaaggcacagcgacactttggtgactgcaagatgcttgtgaaattccacaccatacgtacaaatagggttattttttagctgttcccagttttacccgccaccatcgccaagccacaacatcgcgatgactctcattggatggtctcattttggaccaattaaaattgccagcattataatgaatacatacagcttgtaagaatagcagatcctctcctgtattagactactccggcacgcccagcttcccccgactcttcatgtttatctgaaaacatactccctgcctcgctgtcttcggggccctttcctttggactgattctggacacgggcttcttcctccttctccctttcagtctcctcaaaggtgggaggagagtccatatcatcctccagtcccgcgaacgggttgctcggtagcgttcctgatgatcctggctgacactctttatctctatctatgctttccggcataagcatgacgggctgctcgtcatggatttttatacattccttctcgataacccaccgcatttcaaaagacaatttgtgggtaactttcatactgtatgtgacaaaattgggcacaaggtactccgggtccacgagccgaaggtttatttctttgccgacatccttgggctcctcatcagcggagcatataatttcgacaagaggctccgaatggcatacaaaactgtgccttatcgtatatttttcgggcccggtgaaggtaaggggacgatattgagctgggatttcgcagattgatgacagtacagcccaaaaccggaccaacctcgccgtttgtgacacgttctggagtacgtcagaagacttggaccagttgggaatgactttgatggtcagagaaattggatccggatgattgagttgaatgacgctcggtgtcgcgatgagaacctgcaggttcaagcgaggcacagatgaggtgtgaaagaacttcttgacatgctgccccagactcaatggagcaccatgcatacccggaacgaggcgctgggaatgaacagtgcgtttgaattcgtgaatctttagccgactgtctgcaatgggaggactcagatccgccaatcgtagaaggaggggatattgacagcggacaacatccttgacccctttgcgttcgtagataagcttggcttcaagaaaatagtcgacggacgcgtagaaatatggcgatttggtccggcaagttggaggaagaggatgtccgctgattgattcttgatcaatgggcaagaaaagtggcatcgaagaattggacatctcggagctcacacatctatagctagggttctttggaagcctgatgtggaaggaccattcgtggcgacagattgcgtcgggggggatatggaccgctcccttgaagagtgattttgtcgagccgagaagaatcattacacgggaagggttgtcgttcacctgggtggcgagacagccaaacagattgatggtgagatgtgcctcgggactgataatggcggtctgtcgatatattcgcccggaaagggaatcaccaggatggaagaagattgggggattatgaagctcaatacccaggtcggggctcgaggtcgcttccctcgtggtctcgcgaagcatcttgtcgtcgagggcgtttggtcttggtaacttgtctgcgttggtttattgacggaggcgtctgaaagatccacgtcgccagtggtatcgcgggcgggcggcgactgtcactgcatcttgggattgacgtgcagagatcgtgcacgatggagttgcaatggaagagaggaaaagaaaatggaagaggagagaagaaaatggaaattctggacgacgaggagcgcaacaaaaggagcaggaagctcgttgtaaggaaggagacaaagtgcgtgctcctgccctgctcttgccatactcaagccacaccaagccgaaagctcgtgagtgagcttttgcataacctagacctaggattgaacagaaaattgataaatctgtggcctaaaagctcctaattgccgatagatcgtcgctgttctgagagtataaagcattctgacttcgtaccgtaaaggcattgagtcactgcgtcgtcgctgcaattctccgcctgcgagaccaagcatgaatgacaacaaacttaaaacttcccaatcaaggtagtggctaggccatcacagtgtttaggtagtcctgcctcgctccatgtgtagctctttcttgacaagacaagagcaatattcatcttgtatcttccccttccctaatcaccacctcctccacctcctccaccactactgcctccaccaccgcaaccaccgctactgcctccaccaccgccgctgctacacccaccgattgagctcccacaacctccaggaccaccgcaggctcccgaagcaacacctccgccacaagtccccgatgcacaagctcccgggcagccggagccttcacatggaacggaatgggggtcacagccaggatacaaccctggtgtgtagtacggggggtatacatatgggccatacactaagtaattattagctatcatagcaaatattcgagggaagacaagatagacgtactgtagtatggatatccccagtggctgtaatactcgtccctcggaggcagtgtacgtcccttctttcctgcccgcctgcacgccttttggtatttgtcctcgagacggcgctggtacgcgcggcgggccgcatcgccaactctcttagaagtgatcatctccgcgttgcctgggtcggtgagcttataggctacggcgttgtgcgcagagatgtgcgccgagttgtttggggggcattgttgggcagcccccgactcatgaaatcgattagcgactgtagagagttagcaagaacgaaataagtacttaggttaagagatttaagagatttggcttcatatttacttgtgtcattcatggaaaggcccagtgctttgccgatggaggagatgtgtgatgatcggatcgtctcgcaataccagcaggtacattcagaatacacctcttggtacatctgttggtaggttttgctggtccactcgaatgcttgacctagcttgtcatcactgattttgtcatcatggtcaatgaattttgcgtcttcactggcagaggttacggctgtataatatgccgatggggagagttgatgtgtatgccaggcctaaggacaagtgttagcacgactggatgtggctctggtaggatttcttccagtcaccagatcaacatcgagagttggcacgcaaaggtgagtagggttgtcctgcatgatcgccaaaaacctcttgtactttccacagattcgggtcattgtctgaggggcaacaggagaatgtagccaatccaaatggtacatcttctcaacgaaaacgccctgccgcattgttgcaccgcatagatccagtgcaaacgctgaaaaactgtcccagtatcggctcatcatcttacggatcgctacccccgccaccgcggggagcactgctctgccaatcctgtggctgcttggtattcttgcgacaagttgatctactttgcgggagtctgtaagcgtgtcctcaattgttcgtcggataccttccattgttggaggctggaagcctggttgttgagactgggttctgagatcgtgcagctgaaaggacaaaacctgctggatgagtctgtttgggaggcgcagaggatcctgaaatttctcaaacgcatattctgttgatcgactcttatacgactttggtttcccagattgaggctcaagtactgtccccggcatcgggacgccttttcttagcagtttcttcatgtcagtgtcaaatttaccgagactgagcagctcttttgtcaaattggttccgcagccatggcaggcatattgaaactcgccgtcaccgtacccggaacctatcaggctaggtatggtggctccatctgcatgctcattggcgccacaggtggtccaggctacatggagttgttttgtgcagatggggcaatcgatagccttttgcgtcttgtcttcggtattttcccatgaatggtccgtattcgcaacccacgtagccttggtatcgtcggaaacgctgtaggtgaagtcggaggcgatggcattgttgatgagtgtccagggcattccatgccaccagagttgtctcagccctgcccgcatgcaatcctcaagatatgctctggggttgagcatgtgcgagtgccaaaccataagtacgtctatacatcggtggttaggaaccctcttcccatgcggagaggttcaaccggtatgattgtcatacataccgaggggtggtagctgcccgtttgaccaaagattgccatttccaccagtgctgggaaactcatcataggcgagggagccgtcgttttccatatcctgttcctgtagcgggttctcatcgctcatggatttccaccagctttcgtaacggtcgactgcgcgggctacgaaaatagtccatcttttctctctcacctggctcagagcctcttgttgtgcattgtgatcatttggggctgcacccttgtctgctttgggcgctttgccagtctcatcggggcgtaagatgccgcctttcccttgggtacgagtatcccagagtccccaaagcccgtcagtatatcctatgtcctctttgaggacttggaacgcgtataggagcttgagatgtgccaagcaggaatctgggatagggtcgtgtggtcctgaagcgaggctcaaattggcgaaagacgcggagatatcaatcgctggatgggcatccgcgtttgcattgccatacgatggtggagctgcctggcttatcgacttctcgtgcccgccgagagggtccattgatcgtgtctggccttgatgagcgggttgtgtttgcggtggtaacgtatgtcgttttatgaacgcgaatgcaactggaagaggtctttcttgaccttctgcttgctctgaggttgaggacttgatgaagaaatctggcttgtcaaaaaaagggtgtaaaagaggaaatttgctgaagagatggaagctttatggaaggcattaggtagtggcgctttcaaagaactttcctgttttgatgatatgacggcggctgtgcagctcgcccggcttattatagacttatgggggcgggctgacttttgctcgtgcgagtggtgcccaggatgaacgtggctccagcagatcctctgatgggcccagctttggccatggacagggtctcgttgggctgacctgctacgactctggatccggttctggcgaaatattattgcccacgaagaaagggttccatcgcccgacacaatatgagatagaaaaatattgggtgtgctctcgaaacgaatcggcgggatgagccaggaactgcatcaatgtgagaaggttggcaaggaagatcatgttactaattagtgtgagacaaactagtcagttatcccgtaaggtgatggagaccgcgaagctgacagacgcgcccaagcaaagctcatcctccactatcggacattctttgactgaacacttgcttgccagcgccaatgagtcaaccaaattgtttcgttgggtatcacccaagaaatgttcttgggagggctagataacgaaactcgaagttgtggcttatgcacaaaccatatttgtgtacacacccttgcaatagttgccaacccaacttgaagcttctcatgatgtacgtaaattcaaactatatagcaattattcatgtgccttgtgaccaaagagatcataatagcaaatctcctatggcgacctttcagctctttccccctcgagtcccagttgcatgtcgactagagtaagaagcgaggcaagcttccaacaggtaaataaaaggacgccaaggagagatacaggttctcgatgcatctatgtggcggacactctcagtcaatgcccccggctctttgattgaagatgttccgcccagcccagcgtatcactttgtgctcatcgctaacatcaatgctgataagaaagtgacttccttgacagggctttcatatctgaaaacttattcacccgtaagttattacaggagatcctctagatcaaaaggcaaaatcgagaagccatcccacgcagagctcagcttggagcataattctcaagtacttgattcaaacaaaaagaaactctgctggaagtgcattttgaaagaagagcatctgaaaatagcgtggagggaacagaaagattggtcgctggccttggtgccttggatcattgttacaccgttgggcttcgctcaccccaacctcacttgctcccacattcagacctcacccttccgctacgtctgactagcaccacctagagacatcctccggcattcgcccaatgcaacaacagatttctgattctatttcatctacagcatcaagctttcatcgcggggatagtgcaaagatcaagcatcgcaacgctgtcgtccctgaacctacgaacagaggtaagctcagaaataccctccaaaaccccattctgaactcccgtgggaccaaaatactgactccagggtcagacttccagtcggataggtacctacgatgggagaatcggctctaaaaagtacgcgagcgttgatgaaacaacgcgcagatgctcgctgtgttgtgaagccggtcttggcgtcgcatcacatatgtggcttgtggaaccaccccgacagtcagcttcgagagcagattctgagaacaatcgaacgattacctgacgctcaagccatcgatattctacgcaaagggtacaaagatgctgcagaacttcctgtcaccgtttgcatcacgctaactaagcgctcttcatcgtgggcgaagatcgatcgaatcctccgggaactgcgaaagattcttgacaatcatgggcttcctgatatcctttgcgaagtcatggagtcaaccgtcttttttcattcatccatgtctactgctcataccccggagctcacgacaacggaggaagaggagaccaggctggtctcatttgtgggaaccagcattagcccgctgactacaactgcctcgggagagttttcagagctggcggtagaaggatcgctcgggttagttttaaaatggaagcaacagggcggttctgaaaaaattgtggccttgacatgccgccacgtggtgcaggatgaggctcagttgaatgctacgatgaacgagccgctgaacgaaccgatcaatatcatacaacctggtcctgatacattccgacaaatgcaggacaccttgactgagatccaagaacaagctgaaccgggagagatcagagagcatgtcgtggctgctctccatcagctatccgccttccagcaactcagtgtgcgggttgttggtcaggtcttgtttgcgccacgatttgcacttcgccctgttgttcgtcaagataccactattgttcgtcaagacgatgaagccggccctccaagcagggaattcaaatggcttaccgactgggctctagttgatgtacaccaggatgtggccccagatttggctaaccaagtcactgtctcgagagcccaacactcgcgtctccttgaccatgaagctaccatacgcgtcaggagtgctagagccgacgatgtcacgcttgagctatctggcacagtttctgaggctgaactgatgacaatgccgagggacgaaagcaaccaagcggtcgtcgccaaatttggtgctgccaccgggctaacgttaggttcgagtaatggtatgtactcttccctcagaaccggaaagaacagttggagccaagagtggtgcatcataggtatgaaaaaggaccctaatcagggcatgctagcacaacggactatgttttctgcgcagggcgactctggtgcagcggtctggttcttagatgggaagatagctggtatgttaacgtctggccgctgtcgtggagttgtggatgttacctatgctaccccaattgaacgcttgctcaacgacatcagaggaagggggtatgatgtcgaattaccctagttcagctacatggacaagggcagaagggagacgagatgagttaaggttagtccaaacaaacgcatggttgcagtactcagggaattacgcagtattccactaaattgctgatattttagtgataatgtgagagactcaagattggtatttgctttcgaagggcggggaggattgaagcggtcattaggtgaaaaggtcgactcctgatgccttctgaattgatactgagcggaagcctagatgtggcatttcaataagattgaaagatcgacgctaatagattattcgatgttttcgtatctgtgcaagtattttcactgatcttccccggtcaacacagtagataggatcagaatggctccctacgcagaaagaaaagcttctactaagctcttaggatgactctcgggtcattgcctggaccagtcagcccacgaaagagccctggagaagaatcactacccttgcttgtgttaattcatgtagtgcttgtgtgcacagccctgtctgatggagccaagcgccctgccaagatattgactcttgcctgccctgtcacttttctccagtaaagccacgttggtgattgaatcgcacatttccgtttaaattggaggagttatcacttcttctggcgcaaggactccttattgtcgtgagaggcaattaatgcagcagttctcaacatgctccccggcaaaacagagctcgcgtcactcttaaaccaaagtaaacacaccttccagaaattcagggatttcgagtattctagaccaattgcagccgtccataacgggatccgccttttgttactcaggccgggtagatttctcgatgacatccaaatcgatctcgtcgacgtctgcttcgacgatcagcttagttatgaggccctctcgtatacttggggcgacggaaagacaacgcgtccgatccgtgtcaacggatcacgactagatctctcggcgaaccttgaggtggcgctgcgtcacttacgatccctaaatgccacgagagttttgtggattgatgcgctttgcatcaaccagggcgactacgaggagaggtcagaccaggtcaagaagatgttccaaatctaccggcgggcgacgaatgttattgcttggctgggcaaagagagtcggggcagcggggattcgatggcccttgtcacggactttgccctgttcctcaggggaaatggtgttgtcgacttggaatcggcccagaatttccacaaccgagccaaaaagtcacggaaagggcccagcggagacctgaatagtcttggtttcccgttcaaggaaaagaaacgagcctggggatccttgtggacgcttttgaggcgggcatactggagccggatgtggatattgcaggaactggcggcacgaggatattgggggagtaaagactcgatgccgtgtactcttcagtgtggttgggataccgcgtctatgcacgatcttcaaatgatattcgaccatttcaacatcatgtggtcatggtattctccgagtgaggtcggggactggcgccttcagcagccgttcaagtcattcacacgacagggcttcatggatcccccgggctttaccatgtgcgctactctgaaattgtttcaccttgaccgtactgccggaggatcgacgctaaagaggttgctgcacttgtcgcaccctctggacgcctcggaagaccgtgacaagatgtatgccctcctcggtctcgtgtcccaaaaccatgcaataagtccagactacacaaaatcgctttcagatatcttgatagactatgtcaggaacagcgtcgagacagatgggtctttgaatgctctcttctcgaaccgtttgtacccgtgagagtcagggctgccaacatggacgccagagattcgtaagaaatggcatgctccgtgtcaatgggaaaagcatgggattgacacactgttcaaagccagtggcaacaagcaggcagatgtcgaattcatcccataccaggacctgaataaggactcggtaatcctacgcaccaagggtgtggtcattggcgagattgaccatgtcatcggcccttgccgcatcgatgatctcatacaacgtaccataatgaaaagagcttctcagtttatccaccgaggaaggtatgagttgttcatgatggagctcagccaatttacatccgatctcgagaatgggtcggctgactacggctccttctggcgaactttggtcttgaatagaaatgaggatgttaatgacacgcggcaagcctccaagggtctgcgcatcggaggggtcatcgcacttcgaagagactggttaaaagcaaaagaaatggcagaggtcgccgcgggtgaggatggcgtgaagcatagaaacacctttcgccggtgcgtatgcagatgcgtgatgaatcgtacctttttcagggccaggggccacagttatacgtacatgggcctcgggccgtacgacgcccgccctggagatctggcggtcgttttgtttgggtcggatatgtgtttggtattgcggcccagaggagaaaggttggaggggtattatgtgatcgggacggcatatgttcacggcgcgatgcggggagaattggtagaggagcaaggtgtgcaagagcgtgtgtttgatctttactaacagatctaagctaagtcaaacaaatcatggtattatgtcaaacaggagattctaccatctcgaagcctctgatgccagaagaagtgctgtataagaatacaatacaaattttcaaacttgatcaactcaaatacctactgggagggcaaggttgatctgtagagttcaattttaagattcacgattgcaccattacttggcatgtcaaattgcaggtgctctcttcaccatcaatcatctgaggaaatgaaatgtctatgttgaaggaaaaaaaggttagatctattgtctagtatacatccactgcagaaaaggtaaccctctgctgacccgcaggaacggtgctaccaaactcaagcccattcccgttgttcaagtagacgaaggtattaaaaactcctgcgggggtggtagaagtacagccgaatgacgcccctgttcgagaacaggcaagtcgcctgtagtggtaacccgaggaattttctggtaatccattattcaagtcccaaatggtaacggacccaggattttggttatcaaaatcgcccgtatactcgttgaatatgtcgtaacttgttacaaggatatatcggtttttgatgccctggtatataaaaaaggtatcccccgtcgacgggtcgaggtaaaactgtgcaactgtcatagacgaggggggttgggcccctgaagagtacacgaaaagaaaagttggaggtgatggagagtagtagtagacagggctcccaaaagttccgctgcctgctccagatgacagtagcgtgaatgctgttggttgagggatcaaggttgatgacgatggagtcggagtggctgaatcactaggtgggacggaagaagttgttgctatcgaaaggctggaaggtgtgggtgtagtagatatcgcggatgtatcggatgtcgaagacacatctagtgtagtagagacacttggtgtgcttgatgagacgtctgatgaagaagaaatgctgggcgtgtttgatgaagtcccgacagctactgaagtgccacttccgggtgtaggggtcaaatccgtgctcgattcaggtggtgttggagtactacttgggctcaaggtagtatcaagggcactaggtgtggaagtttcgggagtcgtttcggaaacaaaagagctcgagacaggagcagcggtgggcgtggcagaggatgagacaataactgatgaaggagagccgtttgttgagggagtcaaaacgctactcctttggcacttgtgcttgtgtgcaagcccttcagcaagggttgctaacacgacgagagaggagagcgaccaacgcatctttagggtagcagcggcgggacgctgtggtttaacgtgcaaagtaaggtttagggacgagaaagaggaagaggaagtggtcgcttcgttttgggagagagcgtgtatatatccacatgcaatcttgctttagtatgccgcgcctttcagctttttacccgcgctactggacgatgccaatatttcccccttaggctagagagtattaggagtagtcatcaaatggctataggcctcggtgatagcgtgaagaagcgtttgcagttgaagaagaccaattgttggtggggactgaatcaatagtctttgttttgaggcccactgcacatgttcctgcatcacattatggatcagcttcatctcgtccttttatccattcggagatcgaaaaaaatccacatgtgcaccagtgggtgtggttgcctcctaaataccatacactgccttgcaatatgatacctaacttgagttttggaagacttgaaagataaaatgaactgattcactcagttaaactagcagtattgaatagtcttatgcgtgtattcgttatctctctatacattagtcaaagcggacccatttcactcttccttatatgtgtacactccgttctctaccagacgtcgccacctagccggatgtgaaaataaaagatgactcaggtctcaacaagtcttattggaccactaccaagggaaaaagctccatgtgattaaaaaatgatagtatataacattcgaagtaagagtgcagaaaacactgatggaagggtacatgggagttgacggatcagagaacgccagcccgagaacagaccggctctgcagaagcaggccaaaaagaaacatacaacacctggtacagtgtaacactctagcagcgcctggttgaagttttatgtgggcggtattataaatatcaacgcatctgagagccatcttcatcatattatcttagaatggcattacagtagactgaccattttctcgttgaggcagaattacactgtaaaaatagaaaagacaaggtagatatatatctaccggccctctcttatgggcattgtttaatcctacttatcgggtgcgtgctgggctgggtgtcagagcctattaaaacgaatgaatccttgaatctttggtccagtaacgaaacttctttccaaagaaaataaacacaaccatccccaggagagtgattcctacagtcatagccataagaagcatcgtaggttgaatgaaaccgttactagccgcccagtcgttcataaagtaagtcatgccaaactacattatgtaagttagatggatacaaatgagtcccttcttcggaaagacttactccaaacgtattcttgcagacggtcgcaattaccataatctcgcccgtgacgggcttgtaggagtcgattgcataggtgattacaatagtcggtatcgcaacaacctggacaccaactagaccgaacccaacgacgaccacagctggccaaggccacttgtcttgcactcccaccccaaaagcctactcattatgattagacgagattattgtttcataatgtccagggactcaccactaggccaacgagagcggcagcaatgaatggggttagtgatatcaatctcatctccggctcgcgaatccccccattccgtttcgtggctttctgtgaaatccagtccgaccaagggccagcgactccaagaccgataatacctcctgccaccaacgcaaagtttgcatatcctacctgcgcgggagtgaaattgtacggtggcgcggccaatgcttgcgactgtagtaagtttacggcaagcagagcgttggcagcgcagcccatggacatggatgcccagaaaataatagggaagaagaatatttgcagtggagtcagaaagtgacgaatgacatgcttaagagccaagcggtcgataggttgaaagaggttgaattgggcccggctaggtcttcctttgccgacgcattcatctcttattgtcaatgcactgggtgagcccaacgtcgggttttcggttttatgctcgtcctgatctatggcgttactcgagggttggcaagcttggctgtggacattataatcgtcgtagcttcgacgcgtttcgggaaagaagaaaaccagcgcgaccatgttcaccccctgtgcaatcgtgcaagcccagaagaaccaacggtaagagactcggtcagcaacagcgccggcaatgacagggcccaagaacagcccaacgaaataacaccagctagaccaagtcagccaccgaagtattgcaaggacgaggtggtcacgtacaagtatgagcccacatatttaccgcgttcatggaggaagtacatgtccgcaacaacgacattcatgatgctctcattcgctgaagccccagtgccggtcagaatgcgagcaccaaggaaggagccataggaatttgccgttgccgaccagatgagggcggccatgttcaacagacagcaacacatgagtgtgatacgtcgtccaaatatctcgctacaggggatgatgataaagttacagtatcctaaaagcataactgtaactccagtctataaggtgtcaatttttaggatatgactgttagtgtttgaatgttcctaccaacagggctacatcggtcaaggatctgttccatgtctccatgaataacggcgtaagaggggcgatagaaagagccggaatgacgctcgaaatcacgaagaagccttggttgaccatcaccaaggttttccaccagagactccaattctatgcacaggtcagtgataagctgtgggaaccattttgattaccagcacgtaccagaggatcgtgcggatcgtttgtcggctgcggaattaggattgcggaggaggctgtattgtgggcatgggcaaggtgtttctcttcaacatctgtcatgacctctgtacctggaatcatctcaatctgctctccttctgtcgccccctcttcatgatgtgcagtgtgtggtgtttctttcgtatccatggcagctgaaatcaacggtttcttctttcggtgaagactacgatgatccaggggggaacagcatttccaaacaaagcacggaagtaatatatagcgaagctatcgaggacagcagtctgatttgtccctttgcggggccccgcaaaccttgaactcaggtcccaccaccagggtctagagcttcagctgaagagacgcgcttcagtgttcggaccgtctgaatttgacgctgatctatctggcaacctgggcattgtcgatctcttgattcactagttactaacaatccgctgcccgtgttgtacaatctcccacgccatcagcgaagtctaagaccagaatctccttgccaagtttgcctacgacgaatgccaccaactcccgatgagccgggtcatcctttacgaaataccgtctatcttcgtcattctcgaagacaaggatcgatgcaagattgaatcctacaagccaatgtaacatggagattagcgagctatgctccggtaatgggcaagcgcagaacctgcacttcactcatagcggcggcgggacttaccaaggctcctgacattctcagctggacgtgttgtgccacatttgattgacctgatgtacgggtctccatttcgcttagccgtaaaggcaagattcttgatgtactgaactgcggtactcagtgacttatgctcccgaaaggagtataacacaatatgctctattggttgctgggccatgactacagaatccccgctagatctgccaaattctacaatgagaaggtcgatatttggaatggtatctttcaaatactctacgccatcttcggctttaaatgacccaactgtggcgggaccatcgcttgctcacacccaaggatggtcccgccaccacaaatcgccattcatttagagtgtcccgcaagcacgcacaaggagactgttggtcccgcagagatgatacaactacagatacccattattacatcggatgtaccttgcaaggaacaaggatccggtcaatccggggaccccaatacgcggagctgcctccatctgcgaaaagccggaaaaacatatcaatggagatactgctgctggccattaaaccccaccataagagcttgacgcaagagaaagtgtcagaccgtttgcttttgcttccaaacatagttacgcctcgaaaaacctagaaacaaaaatggcatctgttgctactcaagttgtacgttcagtcttatctgctctaatctaggtggacaacccgtgctcatatgagaacagtacattcccccgccaaatagccgtggggcttcagtctcagacattgaagctatcggaaaagatagtgagccagcggcagagtggcgtgctagagcaggcatcgacatctccaaacaagtccgtttggtgaagcttgtccatatgcgataccaacatcccgaccttgatgaaatcacaacattcctccaagactttggtatgcacattgtcaaagctaccgatgaaaagagatggttcggaggctacggtcccgatcaatacgtttactatgcacaaaaaggaccacggaagtttttgggagggacttatgaggtggagactttcgccgatttggagaaagcttctagaatagagggggctggacaaatcgaggctctaacagatgccccaggaggtggacatctcttaaccttgatagatcctgaaggctttcctgttaacctcatccatggacaagaccccgtcaaggttggagaaatccccaaacagctcgtcatgaattacgaagccgacaaaccaagagtgagagaattccaacgcttcaaggagggccccgcagctgtgcataaggtaatcccatgccatatttagatacttgaagagaaagcaccgctaactgactccaagcttggtcactacggcctctgtgtgcagaatttcgatactctgctgacttggtacacgagcaacttcaatatcgtacctactgactttctgtacgtactgcccgaggggaagaggaaaatcgtggctgtattcgcacacatcgatcgcggaaccgactatgttgatcatcataccttcttcatgtctacaaataagacctcgcatgttcatcactgctcgtttgaggtccacgactttgatacacagcaaatagggcatcagtggcttgcaaagaagggctacaagagtgtttggggagtgggacgtcatatcttggggagccagattttcgattactggtgggacacaactggaaacatggtcgaacactatgcagatggagacgtgatcaactctgagacacccataggttacgggccggctggggatgagagtttggcggtttggggcccggatgttccaaagacattcctggactaagagctacctgtttatcaacgtatacggatatggtgtcaaaatcttaactaaataggttaagcagtacctaccagaatgaagatattcgaccttttgaagaatcaaaaagcactccttactctcctcttatcgcgtgacacgttgcaaaagaacaattcattttggcagagatagagcacgtgaagttatatcttaattcactatgtcttcgcccgtaaatagcattcctagtttggctagaagtaaccatatttggttcgtattcattgcgttgagttgtcgagccctggcagcttcattgttgttcaactctattctctttctcttccgtgaccatatttggacttcgagatgggggactctactctatggtactacacattggcttgatcactatgtctaacactttcaagtcatttccacgcaatatatcacttaattttgtttcctattttgtgtcgttttgtaggttatttaacccttagtgaactcgtcccaaagacattctagtatcgaggcatatcggtgcgaaatttcccaatggccaattcggcgtaacagatcaatagcattacaaaacatacttgggtcaactggcaaactgactggcaggcttttaataccttgaggcatttgtgatgatagtcctgtccatgataccatgaactctggcatcgtcgccctgctctgtgctgacatttgcaagctttctgctggtccgaatttcgtgtagcagtgaatggcaattgcagctatgaacaatgctctcgggatgtgcatggctggttccactgagatggacaagctctcggcccgcttgagaagcatccatgcatgaagcaccgagcgacgaccttcgggcgaagctgaccatatgcgagccttgtaggtgactttctctgttatgatgtgcccatcccggcctatggcacgctctagaagatcaagatcggcatatagagcgatatgggtcaagtgccacatgattactaaacctatggggtggtgtcttggatcttgtagtgcatgatcatgatcgtgatgccattggagaagaagctcttgaaattgcctgacatctgcatcacatagcggattaccacgaatttcttggatagacgctaatatcccagctaatgaagcgtaccaaaacatcatcgatcgacgatgaggtaactgtgagcctcgaggaaggcccctaggataagcatcgggggatcctgacaacagctcagtgctcttggctgttcgaacaagactttgccactccatcgccgaagcggccgagaatagctcatcagagcagcattgaggaagtctggctactgtatgcctcaacagtggttcgtggtgaaacgtggtggcgagctccgtatcgtgaacatgcagagcaagaacgaggcgaatggatgcttctgcctgcgcccacctcttccacgcgtactctggacttgatccgccatctccatcaatggtacctagcgaatcacgcatgttgaagagcccagcttgccttgcccaagcaacgatggtgccatggaagctctcagtcaggcaaagatcttgggactgtcctgagagcataccaaaggtttgcccaatagtagctgcctggattagagaaagagcttccacgcttccccgacgaatataattctcccactgcgtgatattagaaaatattcggtatccaggagggagcatggatgtaactcacggacgctaggacagccttattgagaatttggaagatccttctgcctttcactgctgcgctcgcagtccctataaaaagggcccctattgaacaaatcgagagtaatactagagcgttttcggacgacggtcggaacgaaggtgcatggataaggggcatgacgggattgaatcgtgagaagtagagtttgacgcagagattctatcctgattagttgaaaagccaccgtcgtgctgtactcgtcttaactcaccaagaactcggctgaaggcagattagggctactcatccgtggttgtagtctatgggaaagcctttcccgatacatatcgtccacgcagtcttggtcgagaaagtgctcacttgacggctgagggctgggatctcgagagagtcttgtgtgccatttttgctgcactgccgtggcggcactagtgacagcagcttcttgtgaggatagaaatggattcaagcggccgaatgagtttgtacctggctccaggggtcgctggtcggacgagtcgatcgtggctgggtagtgagcccattccgaaagaacagtgcttattgaactgttcagcgcgttgatgtcaaactcttcccctagcaaccaggcaggctcttgaatattgaaattcacagccgcgttttcgatatcaccggatggattgaggatgtttgttgggaaaatggaaaagtcagggcatacaggcccctctggggctcctgctacacccaatgtctcaactcgtggagcagaaggagacagtgtagagatatcctccagtagctgagattgggatagtgacaagctggttcctgaatgtgatggaggtggtgatacaactgcgccatttgaagtaatgtcattatcgtggccaacgtgtgttcttgcatgtcgaagcagtgagtcactggtaagtggtcagcatagaatccatcagacaccaaggccattccgtaacgagctcactggcgactgtaggccttcccacagcatttacattcaaacggccgttccttggtatgggacctaatgtggcgggccaggtgctcggctttagagaagacttggccgcattgtgggcatttcctctcctgaatttgtcgacgtcgtgctccagcctggcccccgacttgaacgctgcgagtatctgccatcgaggttgtacacgggtggaatctggggtaaagcccgatgaggggaggggcaagtatttgtggcggggaggtggcgggactggagccgggttagattgatggagttgcggggaagaacaaactctcacgggatagccggggcatggaaacgtactcaaaatatccgaatcacccaggtcaggttaccacatgaacaatatcaatgtaatcggggaaatgggtaatagtagaatattcaaaggagtcttttaccttaatgttagcttccatatataaaggctagctacttgattgcatggtgagcgaggtgcaaaaacttcaatctaaacgcacagttattggctcactagtttatattaccggaaatccgcagatactcaatgtatcgggtctatagtttcagcaaggagggcgttggctgctactccaataaggagcttaactgcctacattggttcatacttgaccttgttgactagcgttccaatcttttcaatctcaatcctcacatcgcttccgtcttcgaggaaaacgcgcggctggcgaaagtagccaatccctgccggggtgcccgtcaatataatggttcctgactcaagcgttgttccctgtgacagatacgagatctgcttcttcacattgaaaatcatatcccgtgtgtgtccatcctgtagaaccttgccttggtaaattgtcttgatcttaagctgctggggatccttgattactgagggagagacgagcacaggtcctgtgagaccgtgttagctgtgaagattttgtccaatataccgaccactgcacttaccaattgggcagctcccatccagtcccttggagaaagaccattgcgatgtcttcatttggaggtcccgggcagatacatcattcgaggacgtgtagccaagcacgtggttcaaggcttcgtcttccggaatgtcccgtccgcctgtgccaataataacacacagttcagcttcaaagtcgctcgttccatcttgggcacactttggaatcgtgattgctgcggggtagggatctgacagagccgtcctcggctttgcgaaaaggattggagctgctggtagctgcaggtttgcctcctatacggagggattaacactccacttctggattcatgtcggtccataagacctaccttcgcatggtcggtgtaattaaggccaagacatcgaatgaaattgcactgctccctgctcactggggagagcaactgccatgaatcaatactcattgagctatttgtgatggctttttggaaccaagacttacctgcttcaccgtataaacatgcgatgtgatctttccactgtagagatcgcctacaatcaggtatgccttgatttccacgccattcacagagtctaagccaatatctcgcgaagtgtcgaccagttgtcccagatgaatctggttgtcttcgactgcgatgaatcgcacaagatgtgtccagtcaggcattttggtccgcagtatcaatgaagttacttgtttggtttcccatgaaatccaacccctcgaattgggtgttcataaatgcacctaccaatgccgtatatccgaatcagcaccattccaaagatctacccaggtcccgcatccgattccgatgcttacatgacccgccacaaactggtcccgccacaaattggacgtcccgcagaccccaaaaagccggggtagaaactccggggtagaactcgcttgccttggtagaccatgggggtttttaggggcttatattgaacgtctcttgaagtcataggcctacgatggagatcaccacacagaatctcgaccacttgattaaagccttctcagctgacatctcccgttcactatgacgtctgtagaaacaactgatgtccttgtctgcggctgtgggcccacgggggccatgctgtcagtgttacttggacggcacggagttcagaatatcgtgttggaacgcgaccttgaagtgaatgtcgacccccgtggtatcgccttggacgaggacggcgtgcgttatctgcaagcttgtgggatatacgacaaaatattctctgagattggccaatgtaagagtccctgactgatttagcttagttatactaataataactgatcaggtgtgggaaattttcggttcgttggcggcgttcataacgatcttcaaaggaaaccgttcatggtgatgaactacaacactgtacgcaacacttttcaaaactagatacagggtgttttcaaactgatcaaaatctcagactgaagggggcactggacacccaggctttatttgtcacaaacaaccagttattgagaccaatttacggtcacgtctggtagccgagcccacttcagatgtccgtctcggctcaaccgtcacctcaatccgcgaagatgagcaatgggtctacgtaacatatcaagacgcggctggccaagaaaagcacattcgcagccgtttcgtggttggtgctgatgggaaaacggggttcgtgcggaagaagtatctggagcctagaggaattcgtctagaaaccgtctctcagatgccttacgaggaaacctgggtcgcgctgaattggagaatatcgttacccactccaagaacgcatcccagattcccgctttggcagaaaggatacacacccgagcaggtctacgatgccttcttcccttcggagtttcggtttttgtgcaatccaaaccgccctgctgtatgcggtcgatttggaacaagtgaggatcggctttggcgtttcgaattcgtaattcgcccggatgaggatggcgacacaatggcaagcccacagaagatccgcgaagtggtattcccttatatcacgcatccgggaagcacctacgggctcgatatcagtgcgatacattacccagatgattgtattgaagtgcttcgctcacggccattcaagttttcggcccgaagctgtaacagatggtcccaggatcgggtgattctatgtggagatgccgcgcatgtatttccgccatttggaggccaaggaatagcatctggctttcgagatgctatcggtctcgcctggagacttgccatcgctacacgtcaaccctcctccacggagacccccaattatcataagttgttggaagggtggtacaccgaacgaaagcaacagctggataggtctctagcatcgactgtggagaatggcagctatgtaacggaagggaactggcttaagatattcgtcagagattggtatctttggcttatacagcttgttcccagctggaagcatcaattggagcagggcaaccgccgagatgggatggtgagatactcctatcagcccaataagggcatggcatttttggcacatcttgggggcgggatcaactttccccaggtctactgtaccaagctcagtcgcaacaatgctgaagaccctatccaattcacggatgacatcatttttgagaaaaagaagaaaggcttgttccagcttgtggtcttattgaaatctgcagacgaggttgctgacgcccaggagatcttaagatctcgggatgccaactcaccggggttacttcgcatagacgaggctaccttcattatcaataccacgcgaacctattctaaccaagatttcagagataagacagtgcttcatcgactggcaactggtggagagtttgcggcagacacatctctctgcaagggccgaccaaaacctcaatattacgatccctacagaatgtctagagaagtgtctgggaaaccatttgtgattctgaggcccgatcgttttgtatttgcagcttgctcaacgaaggcagagttgagtgaggctcttgcagctttggacttgttaagtatgggaaacctataacggtctaggttccatctcagcaggtcttgagggagttcatggtcgttgaggagcacatgagtctacacaatcgggtcagtatctacattctgaatcatgtatagcgagcaatcggatttgttgtgcacagtgaaacattttgtcgaaccgcaacgtattgacgtagcaattaccgaacgatcaagatacacgggttttcttcctccacggagttttttctccacggattttcttcctccccatgttagatttgcgactgtaattacccctctcctattattagattgcaaggttaaatgattgctttgtcagctcttgcgcttgcaaggctggatcgtgatgagatggggcatgggaaattaatttttcgtaccaacgttcataactcaagtgggagacggctgtctctaattaaacaattaagcttttctttggaaaactccctcttactaaatgtggagcatggtttcggattcaacatacacgtacacggccatcgctgccccacgaaacatccgccttattcacctccaccctggaagtgagtctgacccggtctctctctctcttgcaaccgttatcctcgactctgtccccgattacgaagccatttcgtattgctggggccatgctgcggaccagcgccaggttatatgcaatggtgcaaccctctccatcaccaacagcctcttcaccggacttgtcgcgtttcgacgaccagatcgaccccgcattctctgggcagatgccatctgcatcaatcaggatgatctagtggagaagcgcgaccaagtactccttatgcccgagatctactcacaggccaagcgcgttctcgtgtggctcggtatcgccgatgatcccgtgtacgggcgtgtaccgctaagcgttgtagattcaatccgagaggccctgcaaatgattcccgagtttaaccccgaagatgcctctggaatggtagcgaccataaaggcgctatatgatgattcgcaacggttaagtgaacagggcaaaccgaatctattggatcacgattggctgcctctgggcgcaattctgtcacgcccatggttccgccgcaagtggatgatacaagagatctccctcgccaaggaagttctagttcatgttggcaacgacgtccaattcccgtggctgaacatagcacagctgatgttcagtatcggggtgttgaacatcgacagtgctgcaagcctacaaataggcaaggcgccgaatgccccaactcaccagagagatcgagacggcacatcaagggaacccataagtggcgacggagaggctaagaaaacattcaagggctcctcgttctcattcaacgcggcactgcaatgcgcagcggctatctacatggttcaactttttcgacatactggcacactcctggacggagttgtggttgcgcagatgtttgagtgtaccgacccaagggatcatgtctactcgctcttgagcctgatttccacaggtccaaccattcagcccgactacgaagcctccctcagcgacgtatttcgccgtttcgccaaggcaatgctggtagagggtcagagcctaaaggttctcggcctggcacccaacaagcatgctttctacaaaccggacgcgaaggaggttgagggcctcccgtcatgggttcccgatctgcgagacattcattcgaacgtcttgaccgggtcttcggttcggccccaagcattcttcgccggcggaaagaacaagcctatcctgcaaatatctgcggacgagcgtatcctcagctgctctggccgggtcgtcgacaatgtcgaagccttctccacaggcttgttagacatgatcctggatgacatgcccgagttgagggcaaacccggcgattttcctagagactgacgatcctctaccagagcggaggcaacgacgcttcgcccgctggcttgacggatgctacagtcttgcgtttggccaccattatgcggatcgggatgtatctaaccctcaggaccatttgatggggtcctttgcgcggagcatgacgtgtgatatagacttgatgaggaaccgcgccgatcgagagtctatatccaagtttcctcaatacatggagcggatatttgacgacgtggaaaagggtaactttgatttggaaatcaaatcatccaaaatgccccctgatttaacaaatttgggagaaagcgttaggggtttcgcaatatccttattttgtgtaacaggagatggacgatttgggcggatacctcatacttctcgtgctggtgatgttgtttgcgtctttgttggcgctgagacaccgttcatcatacgtccgacaggccgggaaacatacaccatgattggagaatgctatattgacggaataatggatggcgaagcaataaaatggtcttctcttcttaatggatccctagatactattgcgttagagtaggcacctatcaggtatataacagctaattagataagctttatatgcataacgttctatacatagcagtttcaagagtttttggcggtattttcactgatgtctggattgaagatgaatacaagcctacatacgcaaatgcttcatccttattcacctaagaaaaatcacctcggggaaatcgtcatcaggaccagacaaaagtccttcttcaccacccagcagagtaaactgtataaagtcactcaaatactccctgagaactttcataaccacttcccccgtggcctctccaaaaaaggcctcagcaccttcgcgaaagcccgtaacatccccgatgataggaaagtcgtagtaacttccgtgcaccgagccatttatagttaattccctcttccacacgctcggatgtattgtgtccatggcatagaagaaattccgccaggtgggttcctcaaccgaacttgagttatggccgatcgagccaaagcaaaaaaagggacggtccaccccagtgtattgcacgtcgctccacatcgcaccatcaagattcacgcctgaaaccagtcgctgctcattgggtaatgtatgggctgctgaagcacccccgtatgaatggcccatatagacggttcggttaagcttgaggatgtccaagatgaacgcgacgtcttttgctcggatatccaggccgagaacaatatcctccttgtcgtcaggatttgatcccaccctaccaccgaatataatatcgccgttagggaattgcactatatccgtttcgtaagggtgatcaataaccactatttcgtagcccatgctggcgatttgctgtgccgttcctgtatacagcgtccgggtggtattatggcctggaccaaacaggattgttgggaacttcttcccaaaagtcctatcttgcttgcagcatacctgaacctctaggtttcgaaatatgccattaagccattcaaggtccggaaaggctgccttatatatctcttcctctagtccggccatctcgggtgtcatatacgacgacagagcttctcgcaacttgacctaggtacgggcgtaaagcgagatatcataagccgccgagggtgagttgcattgaaggggtctacccgggaattgtccactaattccgaattctcccaggcaacgtggaatggccctccaggcggcggaaagagctgagccgcggccgaagcagccagcaagacaacgtaaaccgtatcaaatctcatcttttcaggggtgttcagccaagatgtagtgatgaatgagagaaacaacaatgggtaaaagaggtggcgatggcactgtaaagtcccaacttcaaggagtcatcaagagatatagcgaccttcctatcatggcattctcagcgatagatgacgattctcaccacaaccccgcaatcagattcaaccccaaagtccgttcgtgaattcacgtttgaggtattgagtctactttgctacctttgtagcattcccctcactgtattagctaatgcattacgatatatatataaagcttgatgaatgtgatttttttttttccttttcctttgatgaatttcctactttatcttcgaaacattcagtacacagatatgcatttaattgtttgatgagtggaacttggacggtgagattgccgggctttcttcgtatacgtagtctaatacgaatatttcttcttcttagtaagcgatactcaaacccaatctcattcactacgtaggccggtcttggatcatgatcatataattaaaacttcacctatttgagtgagatcaagtatatgaatatctagttttagcagaggcttgagattgagctcccaactcactggcaagacatgcatgataatgaaagtagaagtaaaaagtaaaccaatgtataaccaaacctatattctctgccaattctaactttcaataactgtgtttgcactgataggaccagcgcgtcgacggctaaacactatacgtagagtgtagggtagttggtaaccaccaacgcagaagtaagattgaattcaaatactgcatccaccagtgttatgccgacccacaaatatacggtgtatgtggcgcagccgttagacccaccaggcgacggtgagcgaaccgttttctgtggctgagttgggcgccaaacgaggcagacttcaggttatttagtgcttatatcgatcgactgatgttcgcctcatgtttctcagatcaagttgaaacgattatagatcgtgctattgaaatccagagatttggacaaaccaaccgctgtcgcactactttggttctcgaagctatcatatctagctggtatctgtccttggctggccacgggccaacccaaaacgttgatccgcccatgccaacggagcccctccagcatggacgtttttaggcaagcccagagccggttccatctggccttgtcagcagaagggcaggcccagtacaggccctgcgactctgttgagcagctgcttactgatgttagacagttcagcctgcttccgaaaggcaacaggaggctctctgactgcatgctgaaaattaaagcctttacggataatcttgagccatatttaggtgttattgccataatatgcggatctcatgctggccgggctgatgcgacttatggcacattgaggcttgtcctccaggtgggtaataagaaatatgtctccatctcaggccttgaactagaatattttatggaactaaatgatacacgtgaacctttagatggccagttcctacggtagtttctttgagaagctctgcgatgccctcgaaagactggacgtcaggtttccgcggtaccaggagctttacgacaaacttagctcgcggaaagctgggctagtgggaccaacgctaacgaatgcgatggggaaaacctatgacttgttattcgagttctttcagagcgtcgcggggctcttttcgcgaccaagcggcagtaagttcggtagttgtgaatgagtgactgattctctaatattggggtagggtcaaggcacactttttctaccgttgcttctcttgcccggaagccatttgatgtccgtttcaaggaaatactggagaaaatcagcttctaccacaacctggtcaaggaggagatagagacggaaagagtagatgagatacaagacgatctgtttaaactgaaagcggcagcggcagaacaagctacagagaaattgcaaaacacagtcctcgagaagctgaaggagattcaagcaggcgaagcaccaaacaaggcccagttggctcttttacagagtcttcttgttgatggattctctcgtcaagcaacactcgaatcacagaatcgattactcaatttattgtctcagttcacgaaccacgaggaggcccggatacaaggttcgtaaatcacttatccaagccggaggctacccttctaatggcaactagctgaattcaaatccgctgtaattcgatggattgacccgccggattacaaggaaaatctctgcgatgcgcaagatgagcgcgctgatggaactgcagaatggatctttgataaccccacgtttatccagtggcagcttgtaataccaagacaagactctccgtcaacatcgaattcacccagctcacttctatgggtcaatggtaataatcatattaacaatgcatccttaaagagcaacactgacactatcaaaggaaagccgggctcgggaaagaccgtactcgctgggtccattgtagaagagctccagcggaaactaaaaacccacactatggactcggcggtttgttactatttcttcaatcaaaatatgggcaagaagaataaccatgttgacacttatcgtgctatcctggcgcagctgtttcaccactgccacgagatagacgaagtttatgacgtcttcggcatgataaaaatgagcattattagcgacactcgggcatcggagcatgaattaatcgacacaatacagttgtgccttaaagaagttccaagatccaatttcattttggatggtatcgacgaatgctcaaacgacactaagctcctgaagaatattaaattctggtgtgatacaacatcagtcaagattattcttcttagtcggccagatgtctcaagtttgaggaagacaatctcgccgacttcgaccattactatgatagattcaacattaggcagagatatctgccgatatctgacacccgaattcgatgactttcgagacgagggccttttaccaaaggatgcagatatagaaatgttggcacgccatctaggaaaacgagctgaggggatgttcctttgggctcgcgtgatgatcgaatacttggcctccccagccttgagcaagaggcagcggttggagattatcatggaggacacaccgggaggacttgatcgccttgaagatctctattgtagaattcaagaccggattgatgcccttgacggaccaagcagacaattagcccagaaagcgttggtgtggatagctcatactcgactcacactctctgagctcagtgaagcaatcaccgatgaagattgggggcctgatcgcgatgaagactcgaaccattttgaacacgctgtcattgtgtcttgccgcgggatcatcgaaaagaggtccaatgggatattcaggtatattcatttaacagcaagggagtttgctcagaatgggcctcagcgatctgggcgacaggcattgatcccacatattcatattgccaaggccaagattgttcaatattgtgtcggatacttcaacaagcgaatacctgcaaatccactatcgggacatctgggagtgaatgctgatgtcgacatcaccattgagagatggcccttgctgaaatttgcctcacgcaattggatggcctttgctgttgacttgctttgttcacatgaagctgaattctccggtaaccaaatggacagtctttataccgagatcaacacattcttacaaaatcgattcttcgttatggtttggattgaagctctgtacacattgtgtccgagtgaacttttaacatcgttggagaaaacacggacagacatgaaacgaacggagttgacgcaactggcaccgaactggcaagaatgctggcaaaacttgaaagagctgatccaagatgtttgtcaaatcaatcttgactgggctgaaactctgacagacacaccatccgaagtttggggcgacgttggtatattccagaaaagcaagttcttggcctcaaccaaggcaggcactgtagaatccctggcggcgaggttgcatgaagaggggagaccaaaggcagttggccctttatttagccagtccagaagctctctagatgccaaaagacttgctgtcctaagtgtctttccctgcaggtaagtcgtctcgattaaattcgtacgagctacatattgacatggcaaactgtagattttttcgagacggctgggacagacatgccgatataccattttatgtggaggctccggtgcgatctaagacgacggagccatacggtgaaagcacagccgaagatggccgacacaggaagccgcgtcgctacagatattcccctccgcgatttaagcggccaggtaatcccgctcccccgttttcacaaaccgaattcagggatgcgtgttctagatgggtaataacctatgagatcttctctatcgaggctgctgaatctagccgcctgcttttcatggaagcacctattgatcctcttttagttgagatatgcctcagacagagcctacttgttgacagcgaagactggatctgcacttttgccctatcgatagggccgaacttggacagattcacggtattgaatgtgttgtttgatgtgagatctgaccaaacctaccattgtaggacaatagaatggcctcagagatatcgaccttcatgttggggcacatctaaacaaatagaacgccatagctactactcagtttcaaaggacacctacaattatcatatctcgtggagttgggatgggcgatatctcttgtttcgcgatcgcaatctcaaagcaactcgatgggttcaacatgggacttgtctcgccatattctccatcgaagaaccagcctcggatggagagggtattaaattggtaaactgcttctctaccggttctcttagcagtgggatcaattcctgtcactttcacccaatcaaagatcttctgttactgcaagacgatagagatttttacttatggaagttcctggatggtaagtgtgatttttcaacttggataaacttgaatgatgaacatgataggctgctaacactcaaataagaaaaggagccttcggttctccagctcgctgatagtgagactcgtccacggcctggaattgaaagcatatcattttctagctgtggaaagtacattgccatctcctacagattccagccgtggccaaaactatatcctttggcaacattcttgggaattgataaaaacattgagacttgccatgaggcaacggagacatcatcgggtatgattgagggcccggctgcccagacatcagctgtctcgagcgaagttgctggccgaaataaagggacagaactcacaactaacccaatcatcagccgggctacttcatcttcagttgtggttaagaaaagcaacaaaaacgagtttgacatggccctcctgaaggtggctccgaaagaggtccaaattcatcaaaagcatgaaggacaggacacttccacatctttgatcaagttgccccagtctattccaaccaaaaatatcacggccgaggtgactgcgcccattgctggagaagaccccagatttcaggtcattctcaatgctgggccggcaaaagtatttctcagcagtgatgccggtgccgccgcaacacatctgcctcttgttgttcggaaagaccctcgagcattaaggccacaaccatcagatcgaatcacaggggaaggggcgaatatctctcctattgatagaggcgccgatgctgttccggagcagttgttagaagcccctgagaatgattcatcgaaaccgggagccgagaagccccttggagcgcagtcccctcaggcagcaactgcgaagctcaagcccccaaagaaaaaggggaagctcattagttggattacaaagcggatgaagaagtaaagctatgcttgggacatattaagaaatggcaacaacaaaatgtaataattggctgataggggttgtaatttgactaaatgttgtgcaaatgaaggtatctaactcgaatacggtttacgtaactacatcgcacctgaaatagaggtctgggcatcagacaactgcctcatcgtcttaacattcgacacctgttagacagttgcctttcccataccaagaagcggatgcttaactaccatctcgtctgtgtaatggtcctatttcccgcgactatctcaggcgcgtagtccgtacccaagtgcttcgcaatggttccacggatgatccacgcccatagtcgccagcttccaagctggccagtgccacggttcggacccatagtgacggcaaacacgaaggtgtcatcagccttgtatggggggatggggcgcccggccagccaaggttgcatggccggcgcaaggcaacgaacttgtgcatcagcatgcttgctagtggctgtttgggcgttggcggcgtcgccgaaagcgaatatattggcgtagcgcgtggcctgcaacgttgtgcgatcgatcttgacacgaccatcgaagtcaagcatttcttccggtacgaaagtgatgttcggtcgtacactgaacgccgggatatagagatcagccttaggtgtcctgatggtggcggcattatccgtgactttgtcagtgcgttgcaggacgagcgattgcttcccagccggagcagtagaaacgtccactacacgcgtgttggtcataaccttgagtttgagctgagtcaactcgccaacaacagtctaatgtgtatatgcacgcgcttcaggtccaaggggtaagacatccgcggctatgagagttacgtctttgcttgctgaaggaccgtactcttgacccagctcgcccgctaactcgacgcccgtcagtccagcaccggccacgacaagagagcgagccgttgctatcctctcacgcaagctctgcatcccttgtttagtcgactccgtattcgagaggttcttgaatggcatatcgtccttacaagaggaaccagtcgcgataacgagggcattgtactcgatgatttgttgccgttggtcggctgcgttggtcgatacgacgacgcgattcgcttcgggctctaagcgttgagcgatgcctatgatgtgctcttacttggagcgttcgtacttggcaaaggctggaccaaggggaagggagatcttgttgtcatcaagtaggctaggtacaacggctcgaacaatagcataaggccagagcatctcatcgttggggctgagtaggactacacgtaggcccaccaacgccggggagtgttttagcaagtgattggaaagcggaaagccggccatttcggcgccgaggtaaccacggtgggtgttgtcctaggtgtcgagtctggaccggttaaccgctgagtcttccggagcttgcggagtcgaaagataagtaggctagcaagaaccagcagccctgctgtccaaggatcaacgggaccggagatcattttagcgtagaatatttgaagaaagtaaaacttagctgttgaaaagggattaagggaaaatgagaggtaagagggtaggcgattatgagggtattaacggggctcagaaatgttctttccaaggcaactatctcacgtgcgatgtggcggacacttctacagccggcggcatgtgaagatgggttcggtaagtaactgcctacggagtaggccggttatcttggcctagttccaagtgggcaacgatacacaacatgttgatgaaggggtggctctaatacgtaagagaaaagagaataaagttcaacagcaatggaagctgccagggcctgacaactcaacacaatgaatagtggctctaatacatagccgccttgttgagttaataactccgcaccctggtcaggaaactgtggagatacgtaataagcaaaagaacacatcattaaccgttgcaacgacaaggatatgacactcggtgagcgtgtgccatctgatacagttggtaagataagtggccaacctctgggaccagggggggttggcatgacgtgattcccctctggaattttgttggtgcctcattaacatgcccgagacaatgagctgaggggtgtaaagaggatcaggggacaacttatttcgcccaggctcagcaacctagtgtgatggaatttgggaaatcataaaggaaagcgcttacaaactcccctaacccacaagagacaggggttgcctccgcgaagactccacaaaaccctaaagtagccgagtgatggtatgggtttatgtgggcaaccgggtgacataagagatgagacaccaaattcttataccttctttgtagctatcaaatgctgtaataaagatataattacccctagaaaagtatattaatccttttattagcttctaaataatattaaagcccttctttagtcttttttttaaggaaacttagaatcaagctggtgaacacaacacagagcctctgcaaatggacgcttgaagtaccagtttggtgtctcatctcttatgtcacccactcggtgggtaaaagccagagggttggatcttacccacaccacccataaaggaagagcacgaagcatgtgtaaagcgatgtctatcaattgaacattgaagtcagatctaatcacatggcagttttctggatctgagagtgtcatgtgatcggtcggccggtttaatagtcggaccgagtatgttcgtattagctcacatgaccctgccaccggcatgtgactacggctataattgaagggaatttggctgaactgagcttcacaaaagatgtcttgcaaatgcgggatttccacgcactattatatatacatcagcaatatgccgaatgacacgacttcaaatacgaccaagcctaccgacatatgccgtcggaagggctgcgaattgctagctgtgtcgggaccataccacacacaagattactgtgaccagcgtgagttcaactagcctctcacaaaaagtacacctactcaaataaagatacgaatagactcatgtcatgtttgccatcaggccccagcggtggtccaatttatgaatgaacaaggcttctgctcagcttgtgagtgcctgcgatactgaacaccatgttgcaacagcgattcacatccccctttatctgcaggttcaaaatctgctgtccggggtactgaattgtacccgttgttcggtttgagtgacctcggagaacttgaggatcattaggagaggtgtcaaatttattggaatgcttcccagccctcacttcaatgttttctcgctagagagatatatacaccttgtaacggatgacgattgtattgcagtatatgaactgagctgccacgaataactttagactgagagggttttgttccccttcaccccgtaaactagaattgagtcgcgacatcactcgcccttctggcctgacaatcagctttccttgaccaacgcctcatccttctcaacataagcatctaccttgtatttttcaaactcgcgggcattgattccccgcataaacagaatgtcaagctcctcaaatgttctcccctttgtctccggcagcctgaagaaagtccaaatgaaaaaggccagagcgcaccctccccagaaaaagccagttttccctttccagtccccggcggttgggttaatcatgtacgggttgaccacgttgcagatgatctgcgcgacatagtacacaatgcggctgagacagacgctcttgttgcgcaggcgcgtcgacgacacctcggagatgattgcgtagcatatcggaccgacggtggagtagtagatgccgagccagagcagcatcatgcttgcttgcgcgtagttgccagcctccgagttaggtgccccaacgctgatgaatccaacaatcatcaaaaccatagtgaggagaccgagaccccagagatatagagttcgacgaccgaagacgtgtaggagataccatgagaaaatcgtgccgaccgaagcgagacctaggccgccgacggacatgctgaaggagatggaggtaggcaggccggcctggatgaaaaagtaagtcggtgtgcctcctagtgcagagccacagaacggctgagcagcaaaggccaagcaggcaatttcagttcgtcgaagatccacgccccgaaagcagtcccagtacgatgtgccgtcgtcaacccccttttcaatctcattggtgtgtaccatcatggcgagtgtttgttttatctggtcagggcggctggaaagccgagcgagtgccttctctgcttctcggtacttttccattcgaacgaagtgccaaggagactcaggggcaaaccataaaacgatgaaaagtggaacgggccatgcccattgaatagcaaaaggaatgcggtaagaccattccccagccatctcagagaaagctcgctgaataccagccgagatgagctgcccaattgcccagcagagattgacatacacggtcagatatcctcgcaatgccattgggcatacctcggaggcataggctggagccatagtggcgaatacgccccaaggaattccgcagagaaattgcccaactagaagtacgggcaggttgggggaaaagaaggatataaaaatgcagcagcaaatagcgaccagagaggcaaggagaaccttgcgatagccaaacttgtgggtaaagtagccattggcaaaggccccaattatggtaccgcaactgaccgcgtttgagagaccattctgccaactagcggtgatttcgtaggtgtcggtactggctatgtactctccgtacttggctttgaaagaaggctgggcgaagaaggattggatcaggacgatatcgtacccttccatgataatggcggtagagagaaagatggaccacatggctgccttggggtaaaggtgcatagcagcccagaatcctagtttatgttctccctcggcgccctgcctggccatggagtggtcgttcaggacatgctctgccgtgtcgacatgttcaagctcgccaagggtggcccccttgtgatcttgcataaaggacatggtaactcaacgagggcgaagtgcaatgatggtgtaggctgatgtccgaggcttaaagaggctctctttcgtatgacagagggctgaagagggctgttgaggtgcctagaagactgtagatgagtctcggtggagcatctctatataatatatgcgagaatcggtttgaccatagggatatcggccccacaaacgaacatcaggctagaacgacaccaagggcagccaggtagaggatccccaaaaaccttggaggtggaactggggtaattggttgtggaggcggagttgtgatttttccttgtcaccttctttgccagctgaactcccggcggagaggtttaccccgccggacttcactagccacgaaaatgcggttagcgaagaggtcagatgccctttactaacagaatcaagccattgagcaaatcagcacatggtttctcgatcccccataccagaggtgtctcgggtgctgttggaacctcctctctggcgtcgattcctcgattttccggcgggtggccgatgagcatgtatacgccttgctctaagatcttacggggggcctccggaagggaaatgtcgccaactttcgaaaggtgaccagacatcttgtggccaagtcggacatacagctggaccatctcgtcgtcgcatggtcgatctaagtgtaagaacgtgggttccggatcttcctccaagtctgctggatgagaacgctgagaagaagcattgccattctcattggaactctcagggttgaatgcctggggctgctgcctggcaagattcacagatgtactgtaggcccaaactacaagagtcgcgatgagtatggcgaatggctctaagaagctgccgctactgtagcgccggacatgccagagtagagcacccgcatgtataacagaaagccttgctttgtattggtcgcgtagagcccactggagaatatgccttcgtgctttggcagctttggcgctatcaactgccgagttcaacaaagcctccgtagccaatgtttgcaggtgctgggtaggggtcaagagaaaaagccgggagagatgaaggtgtaggacaatcgggggctcccagccaccggatttactaatcatgccgttgacgttccaatggagtatgtctaggctgtcacaggcactattacgccaccttgagatgactggtaatgcgggtggccaagtttcttcgaccggtgttacaggtgtggattgctgcaccgcggcattgggaatccaaaatgtcagcttgttctggtgttgcgaactggcttctctagttctacgaagaatggcgtatatcaaaaccgtcgtaccgaggctgccggtgcttggaggatgcctcttttccatgtaaagcatttgcagggcctcgagaaccgtcactataatgatacgagacgaattagcctccacagtaaatacgtatagtcgtcaacgttatcatcacataaaatttctaacctgatgtctggatatgttttgcaacttgctttagagtcgtgtgatcccatagatcgtcacaagtcggcaatggggtcacgcccacgtcaaatagttgcaataaaggcgcatggccaaactcaaacatgacgatggaatcaatcaactaccaaagaattagctaacctggccgctgcatggacacgcaattcacatcgttctcaactcacccagaccatgaggccagtgcgaattctggactgtgtccttagccaactttccatatcgtccttgctgtgaagagaacttttctccggagccttgaataagtctagaaaccgacaggcatctaccaggtgattcctctccagcagtgcctcccttaccgcatctccgttgccgctcccaagcacgctgacaacattgagcacggctgcctgaacagttggcaggtcagcgtacttgcttggtgggtccgaaaaaagaaggtttcgaggctcagaggttttatctttgtgctctgttcgggataatgatgctcgtagaagagcgaataagacttctcgagtttgtttcgcgtctggattcgtagagaatatagaaccgacagccaggatacccaaacatattatccaattaccgctttcttcgaatgcagaacaatcccacctcagaaatggatatgtgggatgaaagtgcctgaaatacaaccgataaaggagctgagcatctgctaacggtggaaatgcacttgggtcccagttaggagggtggacctcaggtctggactggagactctcaagaatgttctcataagcacgaatgggcagtagacttccttgtgagtgcgcagattttccagagtcggaagtgaagctgttgataggagttgaagcgtcagaaggagaagtcactaggcctccagcactcaggatcgattgtcgtcgatgcgcccgacctttgaaagatgcgcgagcctcgctgccatcgacataataggttccctcgacagggttggatatctctgatcttgttacgctgtcgctggggccgggcgatggcattggaaggcccaggctgggcgctgtttgactttcttgtgtcgcaggatggtaacgccctccctcttctaccactccgacgctcgggaggcctggttccgtttgctgttgcgcagtagcggtggtgggttgaaacgggaggacgcataggtcagggtcaatagccccgaatgtgaagggtgggagttgactgatccagtcaaagctggtctgatactggggcgacatccaattaatcgagggcatgacaaactcctcccccgccagctgtggatttgggttgaagttattatagaggtcctcggggtttgataatatcacatcgttgtctggaagctgcatggtgtttccattgacgagagcgttcactggtggagttacccctttagctatcgtgtttgagaacacgcctctctcaatgcccgtatcgtttgaggttggcttctgaatgacgagagtgtgctcaatggtgtccggtacgggtacttgcgtcaccagcgtatcgttctcatctgcgatgtactcaagcccaactggtcttccactatgcgccacagtctctgaggaacccatctcctcttggaatagactaaaatcatcatgattgactctactaatggcatcggccggctgggctgtcgaggaagccttgcgctttcgagttgtcggataatcgcacttgatgttcttctcagcgcagcgccggcaaggatcggtcctggagcatcgcacacgactcgttgcgcactctttacaggcccgattagagacgagaggtgtagctgaagactcagcttcgttgcggtgagaagctgcgtggcgggaaagggtgtcgacgcgagaaaaccttttgccgcattctgggcaggcaaaaggccgctcgctcgtgtgtgttcggatgtgccgtgtgaggtgctcctggcgacgaaatgtcgctttgcagtagtcacattcgatttcgcctcgcatttttgccttggacggacttcccgagttcaatgcatgggcgtaagccgccaacccattggcattggcagagtctagaggtatggaaggcgggtggatgacgacggagaaggggaatgtcactttataaattatttcgtcctgcatccatcatccatcaacgtggaaaagagtgtggggaagagaaaggaggcagaccaagtcggggtagcccaaccacttgccagggcacgcgaggaaactccaagacaagcctatgatggcctggaacttcaaacaatgggtcgatggatcctttggtagtgtccgcaccaatcaggcgtcttgttggagggcaataaaacagggcattctcgttgactagctagttccccctgtccatttacaatggtagttttatcaatcagttgatcctgaataactagctaattttgcatgctgcctgtcttaatcgtaaatacaatcgataggtcgttcaagcagatgatttatcacggcaaaaccacgcccctacgagattctctgacaaagacaggcatccaggagagaggacagtttatttcaactgtttggcccccctggaagaccgtcttactgtcatcctgtgtcacccaggtttccccggcaggcaaatacgctgagatcttgcgtgctccaggcttgaacaccggacagcatagaaaactgtcaccgtacatgaactgttcctcaacctcccagcatttcgcatcatcgggaaactcatagaacaaggtgcgcatgacaggagtgccgtgctcatgcgcttccctcatcattctgcgagcgtagtccctcgtctcttcgcgcagcaacatgtacttcttgcaaatttcatataccgtctccccgtatgcccaaacctcgtttggcccgccactggggaaaaccagggagctgctttgtctgggttcccggtctccatgtagacgcatcaccgggcaaaacgctccccattggaaccagcgcacaaacaactctcggaaaccctcgtcatcagggttgccgccatggaaaccccctatatcggtcgtccaccacgcaagacccgcgacgcccatgttcagcccggcggcaagctgattgcggaagcttttccagcttgacgctatgtcgccgctccagacaagggcgccatattgctgactgcctgcccacgcacaccggagaaggttcacgatattcttctgaccttcgctctccattccttcatagaatgtccgtgcatagtcacgcgggtagatgttgccgacactcaagtttgggccgagatgatagcggtaattgtcaaagtcatagaccgaatactctggttctgcttgatccagccaaaacaccttgattcccttggaataatagttatctttggccttgttccaaagatactggcgagcctctgggcttgtggcgtcgtaatacatagtctctccttcaaaggaaaaattggtcctcaggccacgttccgtccggacgaggtgcccaagttccatcatctcctcgtagttttccgaccgcttgtcaacagtcggccaaatggagaccatgagctcaaccttcaactctttaagctcggccaccattgcctgcggatcgggccatgcagccgagtcaaatttccactcgccttgcatgggccagtggaaaaagtccgccactatcacgtcgaggggcagcccccggcgcctgtgttcccgggcaacctcgagaagctcattttgagtctcgtaccgcagcttgcattgccaaaaccccagcccgtactcgggcatcatcgggggcaacccggtcgcgcgggcataggattgctggatctcagtgggtgtgtcccccgcaaccacccagtaatccaacgcctttgttgagtacgattcaaagctggtgatgtttttacccaaaaccgctcggccaatcgctgggctgttccacaggatgccgtagcctaaagaggagagagcaaatggcacactcgcctgggaattacgatgcgcgagctcaaggtctagccctttgaggtccaggtgtggctgctggtactgccccatgccgtagatcttctccttcgcgtccaggctttcgaatcgcatcgtcaggtgatagtcgccgcccagaataggcttgaattcacgggcctcgacctcaatggcgctgcatttcgggtcaaacaggtcccgtcggtttcggctgtattcctccagcaagacttttccagactctgtttcctttacagtgattttgccacggctggtaatttcagccgtaatcttgccatttgtgattgttgccggccctgctgttcctggacaggagatctggggttcaatcgacggcggttccttcaaagcccatagttcaggtggcatggacgccaacttggtggcgcggactcggaaggcattggcaccccatggctctatccagacctgctcgctgtcgtagcgatagatcaagcgcgaggcttccttgtagagcatgatatgatgttttcaaggtctgattggctactatagacgatggttggtggcgagagtaacttaaatctcgtcgtttacacagattggaggagtgggaatttccaagaaataacggaagacaatcatctacacgtcaaatatgaccgtattacaattcacgattcttttctccacctcgtctcctgctgagagtggatcaacactgctgtaattgtgcaagatagctgctgttcagccaatgtacgttatctgtaactcaatttccgatggagtcttgatgtcaatccttggtagatagctgattaaatttaatttgcccagtctctctccatgaacatggcccccaccggaggtcaacctatgcctccgccggaattcagcactcccccaccggacatatgccaggaaagggggcacattacgtactctcgcgtttctcgccatgtgacttcaggcacgacggctaaatccgctagtaatatacgctattggcatctgtatcatacgtgactgggttgtcagtcatagatggaagcccgagggtaccatagtgctgcgtgaggacttctcttcctgccctccttccccatctcaattcacgaactagacaacagtttcttcagctaaacagaacatgaaaatgtttaatatgaagaaatagaaacccataactccctataaattataccgaatgattgaacccctgtatattttgcggcttgttgtaatcttaaccctcaaatacctgagctttgcggttggccaactcagttttaggtaacttgtgatttcgtcaaccaaaacttacaaggattcaacaaggtattgtggttgaatttcaagtctctgaagagggtctctacaatagggagaagcgtagttctgagggacttccaactcaaattagtcttgatatagcgtgatgtatttatgcctagcgcaaccctgatactgaaagacaatattattctctttacctattttgatgcgaatactaccattcagttcccattgctagtttaatcggcggggtgtgatatttgttctctctccgcttaatggaatggatactcagcgcttcatacaactacacctcattcccaagaatctcaaatgcgaacgctgtagagttagagggcggctcaacagttattttaagctatgattaatgagctaaatcaggcggcccggagacattgggaacaataacttactgtgttcgaagtatattgataccgagtaatgccgaggtcaacgggactaccggtgtcagcttggttcccattccaatcaaatcggtaagcctgaacatcgacagatccttcctcaggaagacctattccgttcaagcccgagatctcaatgtcgtatgtactctgcaccgtcctagttcccgcaatgattttggcggtggtatcggaaacggtggcaaagacatcaaaaagaagatcagaggaaatggatgtagcaacccgggtaccagtcatctcggcatagtacttgtagaggtaccattcgccgttgggatagtatgtaccgtcgacactgaacacaagattcgccatatcgctatgcaaaccaccgccgctcccccagtttgcacggaggcaacgtgcgttgtgtcgctcgcactgagcaatgaaaaagactgaatttgccgggttctgctcagatgtccaagcatattcattaatatccaatgggcggtctggcaggctgtagttggctctaaatgtattaaactctgggatggttctctctggttccctttcccagcccccgatttggtgccaggagtagatgtcagggatgatgcttccttttccggacactgcttcgacccaggttcgccaggtttccttatcgagacttggcgagtgtgccatggatggtccgcttatcaacgtgtttggaagctcggtcctagcaaagacaaagattgatgagtatgaggtagcgttattatgttctgggaaaacagctcacctaaacagcacggttgcgtgcacataatactcgagatactgctcccacgtgcgagcccagaagatctcgagctcgggttcattccaaatgtctatcacaagaccttccagcatgtcattggcgtgaatatcgctgacaacctgtttgatgaaagtatccacctcagtccagtcgccattgtctccagggaagagcgcatcattgcctgacccgccatctgcaccccacaggtcatgaaccaagaggatgaaatcgcctccaaacttccgagtagtcagatagttggacaaggtcgaattgaaccgcccaatgtatccttcgtacccgccaaacgcccaccctttgctaggggcaggtagttgggctcctcccgcacggcaagcattgaatttgatgtcagtcgcgaaatgttcggggattgagttgtccgcatcgacaccgttatctggccagccgtatatgaaaccagacgcgaggtatttggcgcctccaatgggctcagccaagttgaccgtcgcggtgcctgaagatctcttgccaagcgaccgggctgcaccagttgcagcaagagtgctgataaaagtgtttaacacggcaagcttcatgataggattgagttgataatgtgagagttaatgatgacgaagttgtctatacatcgagagaggatgtgattctcgcatgctgagtcttatacttccaatgtcttcgaagatcgacatttcaaatcaatctccgccggagcaaacaacccaaagccaaggaagaatcgactattcccattcgtgcggcctgttaaattaccaaggcagatggatcaacattgtgtggaccaagtgttcttccacgacggataaaaggcagaatggtcggaaattatgatgttgtctctgacatgcggggaaggcatctgcactccgcggccatcggagtattccctcatcatactacctaccccgcggggacaggcttctcccaccggattccctgaatggatgaggagttttcaagtgaaacgcgggccaagtccacctttcacaatgctcatgtgctttacggtaatatgtgaccgcatggtcagctcctcataagcccacttccaaatctacgtggttgagagttcggatgcaaagtaacaaccggcaatgaaagatgacaggcccgacatatcaacacaatgaatacggccctaactttacagcatcgagtcggtgaataagagtcactcgtatgtcggttaccttcgttcagattaccagagcaggatgtggtcacagcaggcgtcttatagtagattatagaaaataatctagccgtgtttgaagatgacattcgggaatggggccgattggagtgggagatttaccggctggtttttatttcgcacacttatgaggcgcaaggcaatttaaaatacaaggcaattccgatagagcgagtaagctgtacagcaatttgaaacccctccgcgagattgtaaagtcagcagctccatttcggctacctgagatactgagcgttacagctgccttacgcctttaaggcgcaaggcaactggcgcaggcagcaatctgtacgttgatgtgaagagttccaaacttgaagatagtaagtttggttgaatattcatgcgtgaacgtggaacaagttttggaactcactgatcaactttgttcactgctcattctctattttgaaatccacagaactgtaaggctttgttcaacttacacattaagacaagggaggccaaagcatccctggggcggttggcaccttaggacatggttgtggcagcaaatatctttcgcatttctaacatgtaaaaatgtagagttctattcagagctaaagtgaaccgaggaataagtctttcgttccgctagtgactcgtgtttccctccacttgatcctatgcttggtaactgaatgcctccaatacccgattatttgtcgaaagtttcatacatccaccatccgatcacaggttcaatagtgtcgagacccgtcgtctcgccgttgggcgggtcgatcttgttgccccgaagatctgtatgtgtcacgggccccccactgctggtgaattgctgcccgacggaaccagccaacatccttgtctgatatggggttccgttgtcgtccaccttgactggaacggaggcatatccagccgggatgtcatctgtatcgacgggtagaaaagtagtattgccaatctcacagaatgcgcgttcggagccgaagccagtgttgcggatgagctctccttcagccgaccagaaacagaatgatgtcatccatcctgacaggaatgttggccctgagccgccactcttgtagtgggcaatcttgttccagaactccttcacatcggcactggttggctcgtcaaaggagagaatgaagtagtcaagaactgtcttcagccgtgttgcaaactgggcgggctccttgccccaactggcaatcttgtccagacgatcgcgcagctttgtccagtcttccttctcaccttgaagagtcaccgagggtattccgcacatcatagtcattttgtaactgaagtacttctgcaatgttcccatcatgagaattgctgcgacaatcttgtcgttatcctgggtggtggtgaagtcgggcataatccagtctctgagctgcgcatccacgacgtggttttcaagctcgcgcgacatggcgacggccagcttgccgaagtcgacagttttaatggtaccgatttccttgatttcgatttccttctgcccctcgtgcgcgacaaacagagatcggagctcctcagcatgcttgtttatgtagaagcttagctgtacaagaatggagaaccagacgtcttccggtcgaactttcaggtggtaatggtgattgtatgcttggattgcggcataaacgaagccattgttggagccgtggatgtgggcgctggcaacatcctgaaatgaagattggatcatcatcttgcatttctgcgcatcatcagagcatgccgaccggaacaggtcctcgggcgatgtccccgtgggctgcttccaggccacagccgtagtgctcgcggggtagactgtcacaggcatttttctttgccgagagggagatggcaatctgggctgggcgacgagggtcgatgcgatgattgatggtgagcttgatttgggagggtgttgtggacgggccaagtttctgccccctcagtgaccaagtcagaaggtggtacgcgtgtggcttgcacagcctccaggcagcagccaccaacttcaacaacaataattggaaagccttgaactggccaccttacagtaggtaggtaagtacgtaccttctttgaatgcaaccaaaccatcatactcgatccgtggccataagctgccctgccctgcccatcgcgccgccggcatcgctaatttaggggagggggggattcgaaccggtgctgcaggcatttatcatcgcagtcctgttatcttcaggtaacttaactccccgggcaagaatcaaccggaggtctgcatgagggcccctacaacgccgtggttggtggcacccccgttaccgaggatgatcttcgcgctgccaaccagagtgagggcgacgctcgtcgtcggtctgaactagtccatacatcctccgaattaaggctttttccggcccaccattggaatctattaaggaatcccggaaagagaagatggcgtcgctgaaattcgaataaatagataatcggcgcatgaataccaagaaggcacacttgaaaaagagacaagatgggggaatcatttgcgtcgggcacagtcaaaaccaaaccttatggtgcaagtcacggaggattcgatccctggtgaggccactacgcttctaatccctagacagcacgataatgaggtaacaaaacatatcgctgtcttctaaaggtcaacaggaaaatgacgacttgggaaatggtggtccttcatctgaggacgaagttccggcaaagaaagttcccaagctctcgatcggtcttcgttactcttcactctcgccctggcactatgtgatttgaaatctcctcgactgtatatgaagcctgcttttgatgatttcaattgcggcggtattatcctctccccaaacaccctatatatactcgatagtataagagcctacttatatgtttaagataaagctctgtagtttagtatccttacttttgtagatattgaaaataagattatatggaagtactagtttagattaaaggagctctatagctataaagctatctatcttatatataaggagctcctagataagctgaagataatactacaggagcgaaatatcctgatatattacaatcttaagattagtataataagtagtaagagcctagataagactgagtttacctttaccaatagtaagtcagtctctactcccctcttattattcctgatagtatttactctactatccggaccagctttctacaagatattaagcccctctatgccggttttataggtattaacagcatagttcagcgatcataactccgcatagaggacgagtggctacagccgctcttctggatgttccagcatatcgcggcttgcttcgtggttattgaggcacagcacgtgatgagagacaggggcgggaatattgctatgacgactttttcagaggctttcccaacaactcaaggatgcgaacgtcgggatgaagctactgttcgtacgctacagcaaatttgaaaattcgcttgggaccccggccaccgttattgatattcggcagtcggctcagtcacgaagggagagattcaacatcagcctacgccccgctgatccattcttaggtaagaggaggtttaaatactgctgttatgggttgtgaaaaagcgctttggtttcatcacttggttgttgactgagatggttttcctcgtttcccatcgttaatccctttcctaagctggaagcgtcgaagttgaagtttgccattcatccgtgtgcatccaataggagggaaggtcggtataactgacatgtattctcatggctgacactcgccataccctgctccggggtaggcatattactggtatcgcaggacgaggttggattagttggattagttgctctgggctctgacaagggaatcgagtagctcaaagactgaatgcccacctcatgaaaattgaccgcggattcaatcggccgatcctgagagactatccgcaaaccttcttgggagcattgattgatgatggtgttcaattcagatatttgataacaggaaggcctttcgtctagtgaaagatggtttgtttatgcagaattgtgttgcagggtgggaatacggcgttcgcaaacacattgctttgattcgtagcgggtttaaatgtttgtgatgtgaacaaacaggcaggaacagcaacaaagacagggcctgggcgttctccgaatggcacaagtacttgaggttctaaagcttgaatttcctggcagctcttctcgtgctgttgcttctatgaagaacacttacatcgttcgccttgtcgcctatatcgcatgttgtggatcttccaggatagaaagtgtttacagtagactactttgcggcgcctttgattatccaaggggctatttatcctggatagatatccgaattcttgctccaagtccgcttgtgagagaactgattctacggtctgggcgtattctagtgaccggcccatctgacaaggttcaacattaaaagaatatagagccgggcaatgggtatagtattgacggtgattgcgcgagcgctgtagacctatctattctacctatctaaaaacaggaggtcccaatttgcgattgtgatattgaaggctctgggaaacgttgtcttgtctatgtagctaccgacgagtatcaaaaaaccaatactgctaatcaaaaacgcctggtccgtgagctcttaagggccacgtcatcctgccttcgcgattttgaggtatccctgctatgtctcaaaaatcatggccctgattttggtgttgagtggatggattttccggtcccagaccggcctccgcttcattagagaggtgcatgttgggatgaccaccgaaactccgcgtctcacgcacgacggccatcgcattctgtcggggagttagacgccggactggcgagtaccaggactgcggataacgctcgttggcagactgagcgttatttcgagtagcacgacgccgagatgcgtgcctggatcgcggctgggttccttggaagtgggatcgtacagtcctaacagtaggaacccgtggcgttaaggaagtaccagcctgctgaggcaccggttctagagtcgctgttggcgctctagacctttcaagatctggacgtatcgtgctcacatcctcggtggcactttcacaagcgctggtagaagcaatcaatgcacttgggccgttgatgttcgccatcgcatcagagctgccaacagaaagtggtcgacagaaacaacctggctgtggcataccattcagactcaacgcagctttcatacaatctgcagcggatgagcgtttttcgtcgtcaacgaccagcatgtgctcgagcagaaatctcttcatttccagctcctggcattgctccgctgtcttcgtatgtgccttttccgcgcattctatctcattctcgaggtttctgacaacgagggtgcaatatttgtggccgaatccctcaacattggtcaagaggcgaggcgaggagcagagaaggccatgtataaccaaaccgagtgaccagacatcgaccttgacgctatactctttcactataccctcgctaaaagcgccaagtatctctggcgccatgtagcgcttagttccgaccgtgctgcgcaacatggttgaatcccgctccgccttggctaagccaaagtccccaaacttgacacagatgttgccgtttgaccgctcatgaacaagaatattcgtaggtttaatgtcgcggtgcccgatgctctttcctttttcgtggagatattctagcgccgagaggcattgtaccaacaccagctgcttttgtctgagagaaagattggtggcgtcgtccaacgttccgcatcgcatatactcgagataaagttgtggcaccggcgaaagtttccgaccaaagagcttgacaatgtggtcctgaaaaattgtcagatcatgaatggagtcgcccacaggtattgaacgatactcacgtgtgaacattgtgcgagcaagtcgccttctctctgccagtcgtctgggttgaacttcttcccttttacgggttccttcttgaccatctcatcacctgtcctagtattgaacatataaatcacatttccgaaggctccacgatcaatgtaccgctcgatgaagaagtcgtcatctgaaggtgtcttcgcagcggcggtctgtgcctgcgtgaattgatctgggagcataatcaggccctcgagcatatcgtggctcgatgcgtcatccgaccgccagtttctgatctggcgcttgtgatcgtcggccagaacgaaatccgtggcgtcgatgttgaagctggctttgccacagaccatcgtcacttgcactacctgcttattctccccttggggcaggggccacaggatagactcgtaattctttctactgcctgaacttttcatgtcataggagaccgtcgtgccattcatggagcctccgtctctgacgacgagatgatttctggcgttgaaaaggatagtgcaatggtgagcgctgacttgagagctcttgggtatgggtatgaggcatgatgagtcagtgccgatagtaataccggtgggcgagcgaagaatatcctccaaacgaattctcagcggagggcactcttcttcaatgataggctcggtgtgatcactacctggggaggttgatctttgctctggaggagcatcattgggcatagcaggatggtagagcttactcttcctgatggctctaactgcgtacgtgtggcctctatatccaggagagatagtgattatagtgtccgtcatggctgctgcctaattaatcggatgaatgggcaagcccagagcgtggtgatgtagtgttgttcacgatagagtgtacgcgtatgatgaatgagctgaagcggagcaagtttgacccccgctggagggatcacctcgctcttttttttttcttttgtctggtgttgttacaccacgaaattgcttagtaagtattccaagctgaactgcctagtagcgtgcacagaatgagcaacaaggtatccgtggcataattcattatttcactactcagtcgaatgtctacctcacttgaaatgctatcgtgtggcagagaatgggcatgctgatgctccgctccaggccaagattgacaaggtacagccccggtgcggagtgatgtatgggtcttatccaaacgggatcgattagtggcgattgcctgttccaaatttaggactctccttctgggtatccagagaaggctttgttctccgccaaattgatgatgttctgtgtctgtcacccaaacagatggcgttttggtacttcaattgtcacctcagcgattgatcactccacgtttagtggtaagagcgccatcaattgctcactaacggcgctaaaacagcccccaagtgcgctgtgagctagtctgtaaggtacgctgtaatcttggccaacagcctaatcgtgtacaagtcgggggattcatgggcttgccagacgcgcgcacaaagcagccatcaatgtggtacaggtcttgattatataatctcaccaatgatgtccaccgtcgcgattcgcagctgaatttactccctttcttttgtttacatcctatggcgaacggccggtgcatgctcatctagctgtgcaaaccgcgagccccttcccgtgaccagcggcaaatctaacacgtcggcgaatatggacatgtacgagaacgagaacccagctgaggaagagcttccacgcattcgagccgaagagctcgagcagtactctgatgcgcagctccaagaatttctcctgcgccacgagcgctacgacaacggatttatctctattccagttgatttagagagttggaaagccctctccagtgatgcatcgcagcttctcgtggcaagacttcagtcagtggctttgatttctacaccttgtagtagcgtgagctagtgctgatgtgtatgctgactattgctgagtagggagcagaagctagctatacagaatcatcgtgtaaacccagacgaactttttgcccggctacaacaaatccccctcgacaacaatgaccgtgtagtgcggacatctgaatcatccacttcgataatgggatctgagctcgatgactttcaaggcgagaatgagcgcggcgactactatcttcttcttgccgatgggggtcggcccttttactctatagagaagttggacgccgtggagcaggatcccgaatcacactacgatttgataggcccatggaaacatctcgactcattcacaggtggcttgtctgagtgggaggtgtttcagcggcaactcgaccggtgggagcagttccgcaggtggcagctggagcaccgcaaccaggatgcgcaagcgtgcgagaagcacattgaaaaggtgagaaccatgtacgcgcgcttcgctggtcgctgctcgatgcacgccaggcttctagccgaactagatgaccctgccgaatcatttgagcgagaccgtttccaggcaagagacagagtgcgcaagttgacactccaatggctcagtcaaggaggccatctgtatactgcattctcaaattataccgaagatgtcaggaggtgtctgagacagcatggattccttgatcgcattgatctggatatggacccaaagaatcaggacgagctaactacttgggccgaatacgtccacttcgaattctggtggttggccgcgtacgagagggtgctggagagggcgacgccaaaaatgaggaggcagtgggagaaacttcacgagcaaggtatattcgacaaggatgagaccttcgacgttgtgcggtcggaggattttaggaaacagctttggcgtgagaaggaggcgtccttgtctgttgtccagagacttaaagatcagttatggtttggctcaggctccacgacagagagggacccaaagacggaggagaggatgcacacggcagaaaaggaccatgagcccgtcgagaagagatttaaagctgttctcgctgtccagaacagagggcagttcctcaaatattcaggctatctacaaagccataaaagtctattccaatggactttggaccaatttcgccaaattcaagctgggatcggacctctctcagagaaaacaccagtggatagtcagaagccacaagcagtggaaggcagtgaaggtaaccttgaacccctcgccgccaaaagtccagcagatgctacgaccaaacgcaaggccgatgacgatgaaccagcccacagggccgccgacaagcccaagggaaggcgagattcctcgcaggaagcaccgcatatccagcccaccccaggtatctcgacagccgtacatggacgcggcctgacaacccttccacaaacctcggaagagtcaaacgtcactaccaaaaggcaaagaaaatcgtccccctctgccaaaaatccgcaagactctgagagacccacaggcgagactggaagcatcatgtgccaaggtgcatcagccaaccaagacagcacggacgctacccacggcccagtgacaatggtaggagtcggagtgggacatggaacaagagttactgcaaggggtgtggcggaaacaaaggctgcaagttcaagggagaggcctcaccacgccaccaagaatgaacgaagcccaagacaagcagagcccatgaaaatgcatcagcaaagcaacgctcgtcagaaagacaaggcgcagaaatcaaaaccaggtccagccaacacgccgagaaagcggaagagagaccccacggctgaagagatcgaggcctctattaagcggaaaaaatctttgaggaccttggaaaggaaaaactacaaagaataagtttggtctatttctggccacacttgaggctttgcagcaggctataaagggtctttcaaccaatctcaatagcaatagtagtagtatctgcggtaataattttctttacaatgacaagaaatatagacttgtttgtcctgctcaacaaattccaagtcgacctgagagcggatggccaggcggccgttgaattaggcatgcacttagacttgcccacgattcgatttgacaatgtgcaatccatcttccaaagccatcaaaactcattaattgcaagagatgtgaaaagctcgcccccaaagattagtaaacttgttctgccatgagtgctgcgttagggtggctggctcctacgatggccgcccagcgaccgcacctcagcgcatgtcagccctgcaaacaaccaggtgcagcacccgctcagggcgaccacccactggagcacgctaaaacccacagactaacttggagggagaaaacccaccacaggcgaaaacccatctcgccaccacgctacatggagaagccagaaccgacttccgacgagttcctgcgaccaatctaagcctacaatcccaatggtgttgtcagcagatgcgcgtgcggctgagcctgatgggcagtggtcgacacattaatctttggccgctccttgatttggttcagctggacagccacatcatcaatagtggcatcagctagctcatcgttaaaccataacgagatggccactttctatcatggaggttccgctcccctcgatgggtgcctgcggttatgttcaatgggcaccattggtcggttgcctaattgcctgtacttttccaaatataagatgctagctaccgcgtcgtgatcccacaattgaattgccatcttctagtctatcatttctacctcccaatcgtccacaatggcacccgtctacgctgatcaccccttccctctggtcccaactccaaattacaagttaaagcaagatggcaagaagcctgacgattttgataactgcgcatctttgatgggcgttattcataacacgatattgttgggcctcaattcgatttatctccaggctccaaacatcacagccaaggaccagaaggcattctgcacctacatcttgaaatggcacgaatttctcgatctccatcacaagaatgaggagctcgaattcttccccactgttgagaagctagctggtgagagggggataatggaacccaatgtcgaacagcaccacacctttgagccgggcataaattcattcatctcctatgttaaaggctgccacaatggcaaggaaagttacgatggaggcaagatttcccaaatgattgatgaatttgggaagattctcgccggtcacctggcagacgaaattccaacgcttttaagtctcaggaagtacggtgataagatggacacattatccaaggtgtttgatgaggaaggtgcaaaatcaatggtcagtttagttctcatgctaataatagcgaagatcattccgcttccagttccttcttgcggctaacaattcaaacagaaagcgatgggtcttaatggattgtgcttctttttcgcccaccaagaccttcactatgaggaggatctttatgccgattttccacctgcgccgggcttcatcaaattcctctgccgcaacgtggtttggtggagcaacactgaactgtacaagttctcttcctgcgaccgcctcggtaatatgaggcccttgtatgcggcacaatgaataatgggcagtactccaagccttttcaatcctggctctaattttgctcatcaagtatctgtaactatatcagtttcataattgtgtatacttgtgtattaatgacttgtgtaccatttaacatggagttcagaggacaatttatcttcattaccagtttccacattagtttccaacccaaatgcctcagcgtcttagacagattacaaacaatgcacttttcaacaaacgggaagcaaggtcagtgaacatggccgttggcaaggatcacgagcatgaaaattaaccgccacggggtagaagatcgctattgaactggaatcaggggatctgtttattctcttgccgttaacggcagctagcgcctatgcagttagctttttgaaattcggctaccgcaattgttatctcgggacccatccgtggcccggaatatcagcgagtgagcgagcggggttttccaatccaccaattcctcgacactcctcctgccattcaacgcttgtttacttacttcttatatcccataatggagacagacaactcccttttaggtactggtgctctttcaaatcttaatgcaggcaagcgaacgcggagaaggaactcaaaatcccggcagggctgtctaaggtgcaaaagccgacgggtaagtcttcatggagatattcttcggctttcagctgatttctagcaggtcaagtgtgatgaagtccagccagaatgtgggaactgcaagaaaataagccggcaatgtccagggttccaacaggagcttcgttggtcaaagagacatgaacgaggttgtgcgccgtcacccagtgatggtaattcggcaagtcaaacggctgatctagaagtagaccgcactgctcgacgggtggtaaatccttctgacgagtcggggactcttcatagccggctgaacacatcgacggccagctccgaagctgtcgctgacgactggttgctttcacttcccacaacctggcaggccacgacatctggctgtgatctaccattaaactatgattcgacaggaaatatcgacaccaatatcgaggcttcaatcggctggggatctcaatatcactcacctggcatctcaactccgatttctgcccctaaatctctccagtcccccgcccatctaccaacaactttgattgaatattggttccgccaggtttgccccatgtggtcgactttcgattccgaagtaaactggaacaggcgactggctcgcggtacatggaccacgtcaaaggctgttttcttcacaatgcagaccatgtcggcgacgtgcctgatagatgtgatgcctcagcttagcaagaccttggagtcggcgcgagcgcaggccacatcgaccatcttcgaaggcatggcgcaggcgagagatatatctcaatcacccagggtggcggctgatctcgtgtttgcggtattcggacttggaacttcgtcccattgggcagctttcacggacgagcctcacccgtggttggaatatgcgcgagaattgctctccatctggaaacttgagctctccaagcttgacgagctattgcacgagtatttttgccaggccctcacctactgggaaatgattgcactcacagggaattgcagctccattcctgcaagattgcaaagaaagcgacggcaataccaagatcgacttcgtttagcgatgcacttaccggatagcaacagtgaaacatcgtatgaagatgcggagatgccttgggttcctcgtccagatctcttcgggacacggccaaattcatggtgtggtgtttcgaaggaggtcatcgatgtctttgggcaagttttggctttgtgccgcggcgcatgcgacacaagtagacctggaagcacgctgactgtgctggcgacgagtaatgtcctctgtgatatggctcttgcgcacgaattccagagagaacttcttggcatggactttgatgcgctgattcttcaggaggaggaccacggtttccccgtgcagacgcgagacgacagcacgcccatctcacatctgctgttaaccgcggaagcctatcggcaagcctcgcttctacaactacatctgagtttcaatgacctggaaatgatacaaaatttgaagggttctactggcacaccattcactggagaatcatttcagatggaaggagatggtcaggcgcgggcacaattcctactcagaatgacactcgagctcgtggaaatactcagacagattcctgcccagtcaggttcgagatctattcacccaatgctctacgtttctgccgctgcagggctccgatatgatacttggacagaaacacaagatctctcatcggcttccgtccccgctaaggaggccggtatcatcacaagagctacattgagtgagggccagggcttgttcctcacggcacactctatggagatatcagccgcaaggaagtttgtctgggcacggctgagcggtctccaacaggcattcccggagagaacgagcgatagtacattgcggcttgttaaagcaatatggaaggagtgcgacgactcgccgtctggccatccttgtgcacattggcttgacgtgatggcagagactggtcttggtattacgttgtggtgaatgaagaagcatatcgacgttgatgtgagatgggcacgtttcgtcagacgctcataacatattgctgtcaatccaatctgctccgttcgctaagcctgtttatcatctaacgtacttcagcatctcgtgaaaagattacgctgtaaaaaaagtccacttcttcctcggtatcaccccagataaccatgtcactccatgtagacttagaccatcctggaacttccagggcctttgtctcatccttaaacacaatattaccttcaacctctaccgttcgtagtcctgtaaagacctcatccgtaagtagtgtaacaggaactcttgttaatccgtttttttcggaaggatgtatgtgaatagattcaagtgttggtggcaaggaagtacttaattccatcttcagctcctcttcatcttcttcatcttcttcatcctcttcatcctcttcatcaaacaccccgagatcttcaagacttatcttgagatttctcagacggctcaattcgctcagaggtcctatatgcccaatcaggtggtcatcgtcatattctgtgctgtcgaagtccagtgactctaggcgctgcccataccttctcaaggcaacgccgatcccattcaaattgagtatggcacctctatctgcatccactccgtaatcatgagccaggactatatgcagatggcgcaggcggcagcgccgcaaagcattggcgaggcccgccgcgtcaatgaggcatttcttgagttgcagagttgtgatgttgttcatggcattattccatttcatagtcctaacttcgtctttggtccatctaaaggcggacagccgaagagtcctaagcccgggattaagcagaacaccctcgatattgcgaactctttcgagtctgaggttgtcgtcgtgaccgccacgtttccccaggcgcacctcgcttagaagtgacatggggttctcagatgggggactgggtagttgactctcctgctggctggctgggacgtcgttagactcgctgtcctcgtctccatcttcagaagcggtctcggatccagtctcatcaggaacatcgtcgtcgtcgctgtcggaatcgccacctcgagccgtcgcgaagtaatcatcttccacgtcttgtctgccactgacatacgctgcgagacccatgaatgatacgttgcccatatagtccagagtccgcagccgaggcgcgacaaggagcgcgagaagaggcacgttatcattctctgacttcatccacataatagctagccatctccttttcctctcatcaagattctcgggagaggtccaaagcttctgggcaacgtattccaatttgaagtcagacaaccaaggatcaacttgaagcccctggatattgtgaccgattgacgggtcagcgcataggacatgaataaacttgtccatggagctgccgctcggaccattcttcgaccgcaacgcgacagtgcggtagatcagcgggcgcgcgatactgtgaaagaggtgggatacttgggagagcgcaatgagttcgcaaggcgggggggggcttatccaagtagtagcggcccggctcccagttctccaatgagacctgagtctccaagtgttcgaaaatgcgatgaaggatctcagtcggcaaggagcccatcatttttgcacgtctgtttgcctctcggcaggcttatcctgtcaatagcggccacgaagtgcttatttgaaagaggaagaaacaacctaaggtttttttttccacaaataaaagaaacgcgctggctgagacattagggcagacatacctgatacttttccatttgggggcatttctatccctataggtgcagctcagcaactactaacctctggaaatgacctgtcaattgaactcatccccagagatgtaatgcaaagctcagctagcatggaaataccagttgcgtgctctcgtgtagttgtgtttcattgattaggttatacagtcttgcctatcttacttatactggacttagaccatgtctattcattcttgagagggaacatggccgtcttagcccaagttccaatctaacccataacatgtagtactatcggccgtttcacatgtctcttcttgtcatatataccaaagtgattatctagctcgcaacatgaaattaggtggtgaaagggttgcaggcaatacccaaccgatccgcctcggcttgcagcttcttgttcttcctcaccaaatgccatttgatcacgctcgccaggcaaatggcaagccccgcgaagacaatctgcagaatcatggccatggtgtaccggggctgatccctgtctgggaaaaaatagggagagatgacattgcccagatgaccaaagatgttgacaatggcgccgccggctgcacgtttctcaggggtctggccgagtgtcgacacggcccaggtgtattgaagggtgtttgcagagaagcagccggccgcgtagaggaaagtcatggcatatcgcactgaggggttgccggtcgcgacggtgacgatgaatccgacgactgagcatgacagagggatgatgatgtgcaggccacgttcacggcggcgatcagagtcccatgcgacaaagaatgtgcagagcgttccccaaacatagggaggggcggtcatcagtaatgaggtgattcgggttccaaaacctattcgattgttagatgtgacacaaaaaccatctttgaacgtttaaccacatacctagtccgttcacgatagtggggaagaagttgttgaatccatatgaagaggtgatgaagatgttcaagaacaagaacatataaagcttaagatccgtgacggcaagcttaagtccgtgccaaacggtagacttttcagagtactcaactcggtcatcgagaattctcgcagcagctagcttgcgcatatcctctgtcatgtaccacatcgcaccaccgctggtggagtctgggtagttaggcaggacaaagtaggctgtgattgcaaagaagccactgagagcgccctcaagaatgaagagccacttccatccggcaaggcccatggggccatcgaggcccgcgaagacgccagcagcaatcagaccagagaatgcctgggcgaggaccaggccggagtagagcagggcaacacgaagggcaaattctcggcgggtgtaccagcaagacatgaggaatacggcctgcatgacagcttacttagtaattagagtagcaagcagcaggggtttcaacgtacgccagggaatagtggcgcttcgacgatgcctagaataaactggacgccccagagacccccagcgctggtacaaacaacggtgagggccgagatacctgaccagatgaaagcagcgacagggaggtacacggacggtcgcactcgggtgatgagcatattcgatggcagttgggcaaccatgtatccgacagtcaagatggcaactgcagtctgaaaaatgtcaatttccaattgccgtggtgcggagccgtttcaacatacctggtagtctccatctttgagattaagatcctcgttgaaggtgttgaggcgggcctgggcaatgtttgtacggttaaggtagttaaacatgtaaagaatccagagctgcggaagcatccagatgtccagcttccggacaatcttcttctccagctccttggtgttctctatcccaagttgggcgacgtgattgatgtccgcacatacttccgtcttttcttggacgtacgacgggacagtggccaactgagcagcatcattcacctgattcactgccgtctctttaatatctgccatgtttaaagaatgccttgacaagagaacttcgggaaatgacaaagcaagtgcgagtaaaaggtcatggcatagcacaacaatgtgcatctctcttttatagtaatccccggtggcctgaccaacaaattttccatgatctccgcatcttcgcaagggccatctcccagggtcgttgagggaattcggtcatcgaccgagtacacaggggcccaaaatggcactgatacgatggccaaggaaaagccaaggtgagggggaaaaca

(The sequence listing continues in the following parts.)

The invention claimed is:

1. A method of inhibiting and/or controlling *Septoria tritici* blotch (STB) caused by *Mycosphaerella graminicola*, said method comprising treating a wheat plant infected by *M. graminicola* with *Clonostachys rosea* in an amount effective to inhibit and/or control the STB, or with a biological control agent (BCA) composition comprising *C. rosea* in an amount effective to inhibit and/or control the STB and at least one auxiliary compound, wherein the method is conducted in the absence of a chemical fungicide.

2. The method according to claim 1, wherein treating said wheat plant comprises spraying said *C. rosea* or said BCA composition onto at least a portion of said wheat plant.

3. The method according to claim 2, wherein spraying said *C. rosea* or said BCA composition comprises spraying said *C. rosea* or said BCA composition onto at least one of a pre-stem extension, a stem extension, and a leaf of said wheat plant.

4. The method according to claim 1, wherein *C. rosea* is selected from the group consisting of *C. rosea f. rosea*, *C. rosea f. catenulata*, and a mixture thereof.

5. The method according to claim 1, wherein *C. rosea* is selected from the group consisting of *C. rosea* strain IK726, strain 1829, strain 1882, strain 2177, strain CBS 103.94, and a mixture thereof.

6. The method according to claim 1, wherein said at least one auxiliary compound comprises a surfactant.

7. The method according to claim 1, wherein said at least one auxiliary compound comprises at least one insecticide.

8. The method according to claim 7, wherein said at least one insecticide is furathiocarb.

9. The method according to claim 1, wherein said at least one auxiliary compound comprises at least one herbicide.

10. The method according to claim 9, wherein said at least one herbicide is selected from the group consisting of an acetyl coenzyme A carboxylase inhibitor, an acetolactate synthase inhibitor, an enolpyruvylshikimate 3-phosphate synthase inhibitor, a synthetic auxin herbicide, a photosystem II inhibitor, a photosystem I inhibitor, a 4-hydroxyphenylpyruvate dioxygenase inhibitor, and a mixture thereof.

11. The method according to claim 1, wherein said at least one auxiliary compound comprises at least one BCA other than *C. rosea*.

12. The method according to claim 11, wherein said at least one BCA other than *C. rosea* is selected from the group consisting of a *Bacillus* BCA, a *Serratia* BCA, a *Trichoderma* BCA, *Metarhizium brunneum*, *Glomus intraradices*, a *Pseudomonas* BCA, and a mixture thereof.

13. The method according to claim 1, wherein treating the wheat plant comprises treating wheat plant infected by *M. graminicola* with said *C. rosea* or said BCA composition at a late growth stage selected within a range of growth stage 61 to 89.

14. The method according to claim 6, wherein said at least one auxiliary compound comprises a nonionic surfactant.

15. The method according to claim 6, wherein said at least one auxiliary compound comprises a polysorbate surfactant.

16. The method according to claim 6, wherein said at least one auxiliary compound comprises 0.01 or 0.1% polysorbate 20.

17. The method according to claim 1, wherein treating the wheat plant comprises treating the wheat plant infected by *M. graminicola* with said *C. rosea*.

* * * * *